(12) United States Patent
Deutzmann et al.

(10) Patent No.: US 11,576,912 B2
(45) Date of Patent: Feb. 14, 2023

(54) TARGET GENES IN MYC-DRIVEN NEOPLASIA

(71) Applicant: The Board of Trustees of the Leland Stanford Junior University, Stanford, CA (US)

(72) Inventors: Anja Deutzmann, Stanford, CA (US); Dean W. Felsher, San Mateo, CA (US); Yulin Li, Stanford, CA (US)

(73) Assignee: The Board of Trustees of the Leland Stanford Junior University, Stanford, CA (US)

( * ) Notice: Subject to any disclaimer, the term of this patent is extended or adjusted under 35 U.S.C. 154(b) by 153 days.

(21) Appl. No.: 16/468,656

(22) PCT Filed: Jan. 3, 2018

(86) PCT No.: PCT/US2018/012238
§ 371 (c)(1),
(2) Date: Jun. 11, 2019

(87) PCT Pub. No.: WO2018/129080
PCT Pub. Date: Jul. 12, 2018

(65) Prior Publication Data
US 2019/0328732 A1   Oct. 31, 2019

Related U.S. Application Data

(60) Provisional application No. 62/442,260, filed on Jan. 4, 2017.

(51) Int. Cl.
*A61K 31/497* (2006.01)
*A61P 35/00* (2006.01)
*C12Q 1/6886* (2018.01)
*G01N 33/574* (2006.01)

(52) U.S. Cl.
CPC ............ *A61K 31/497* (2013.01); *A61P 35/00* (2018.01); *C12Q 1/6886* (2013.01); *G01N 33/5748* (2013.01); *C12Q 2600/106* (2013.01); *C12Q 2600/158* (2013.01)

(58) Field of Classification Search
None
See application file for complete search history.

(56) References Cited

U.S. PATENT DOCUMENTS

| | | | | |
|---|---|---|---|---|
| 10,676,735 | B2 * | 6/2020 | Gersbach | ........... C07K 14/4705 |
| 2005/0163784 | A1 * | 7/2005 | Valentijn | .............. A61K 31/675 424/155.1 |
| 2014/0271540 | A1 | 9/2014 | Stogniew et al. | |
| 2015/0148401 | A1 * | 5/2015 | Toyoshima | |

FOREIGN PATENT DOCUMENTS

| WO | WO2013/023084 | 2/2013 |
|---|---|---|
| WO | WO-2017/015637 A1 * | 1/2017 |

OTHER PUBLICATIONS

Cheng et al. (2014) "XP01 (CRM1) Inhibition Represses STAT3 Activation to Drive a Survivin-Dependent Oncogenic Switch in Triple-Negative Breast Cancer" Molecular Cancer Therapeutics, 13:3 675-686.
Dang et al. (2012) "MYC on the Path to Cancer", Cell, 149, 22-35.
Drygin et al. (2010) "Targeting RNA Polymerase I with an Oral Small Molecule CX 5461 Inhibits Ribosomal RNA Synthesis and Solid Tumor Growth" Cancer Research, 71:4 1418-1430.
Felsher et al. (1999) "Reversible Tumorigenesis by MYC in Hematopoietic Lineages" Mol Cell, 4, 199-207.
Jain et al. (2002) "Sustained Loss of a Neoplastic Phenotype by Brief Inactivation of MYC" Science 297, 102-104.
Lazo et al. (2016) "Drugging Undruggable Molecular Cancer Targets" Ann. Rev. Pharm. Tox. 56, 23-40.
Li et al. (2003) "A global transcriptional regulatory role for c-Myc in Burkitt's lymphoma cells" Proc. Nat. Acad. Sci. USA100, 8164-8169.
Patel et al. (2004) "Analysis of genomic targets reveals complex functions of MYC" Nature reviews. Cancer 4, 562-568.
Poortinga et. al. (2014) "Targeting RNA polymerase I to treat MYC-driven Cancer" Oncogene, 34:4, 403-412.
Schmidt et al. (2013) "Genome-wide Studies in Multiple Myeloma Identify XP01/CRM1 as a Critical Target Validated Using the Selective Nuclear Export Inhibitor KPT-276" Leukemia, 27:12 2357-2365.
Soucek et al (2010) "The Ups and Downs of MYC Biology" Dev. 20, 91-95.
Soucek et al.(2008) "Modelling Myc inhibition as a cancer therapy" Nature 455, 679-683.

\* cited by examiner

*Primary Examiner* — Jeffrey S Lundgren
*Assistant Examiner* — Gregg Polansky
(74) *Attorney, Agent, or Firm* — Pamela J. Sherwood; Bozicevic, Field & Francis LLP

(57) ABSTRACT

Methods are provided for treating a subject having a MYC-driven neoplasia. Aspects of the methods include administering to the subject an amount of an inhibitor of a target gene effective to treat the subject for the MYC-driven neoplasia. Methods are also provided for identifying a MYC-dependent target gene in a MYC-driven neoplasia. Aspects of the method include identifying the MYC-dependent target gene based on a phenotype detected in a first tumor cell line conditionally expressing MYC that is absent or quantitatively different in a second tumor cell line conditionally repressing MYC when the two cell lines are contacted with a CRISPR-based gene silencing agent. Kits and cell lines for practicing the methods of the disclosure are also provided.

5 Claims, 10 Drawing Sheets
Specification includes a Sequence Listing.

FIG. 1, Panel A
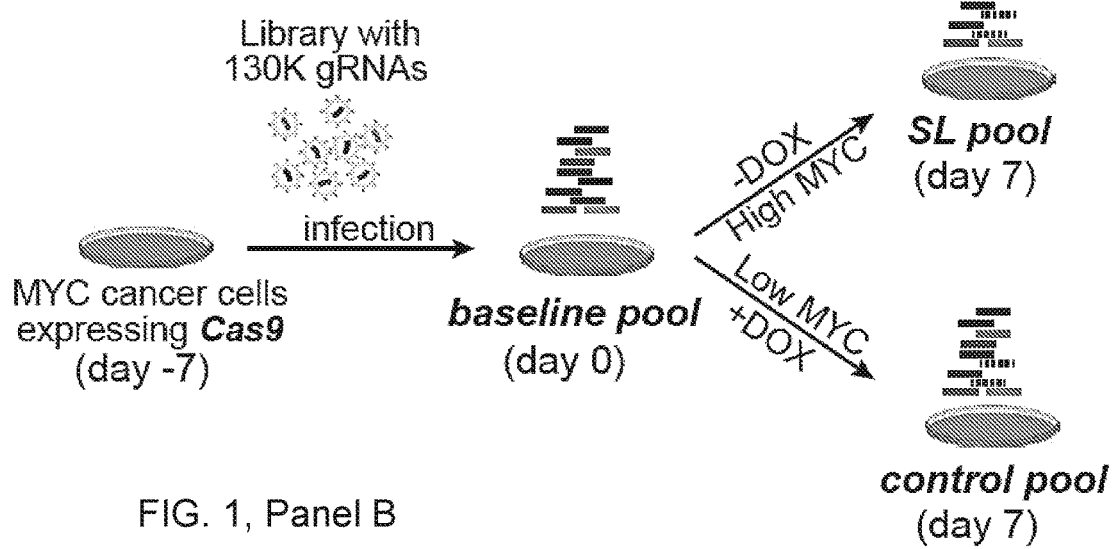
FIG. 1, Panel B
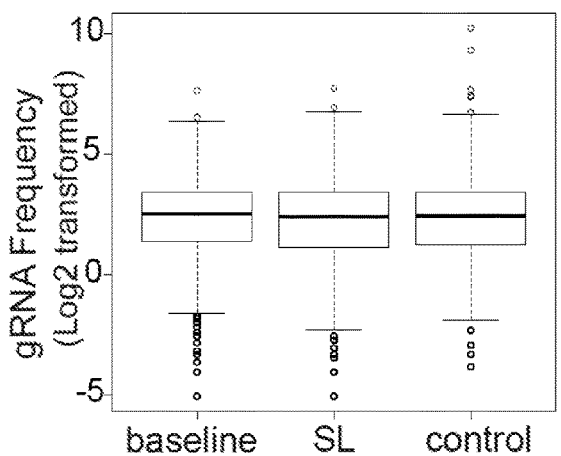
FIG. 1, Panel C
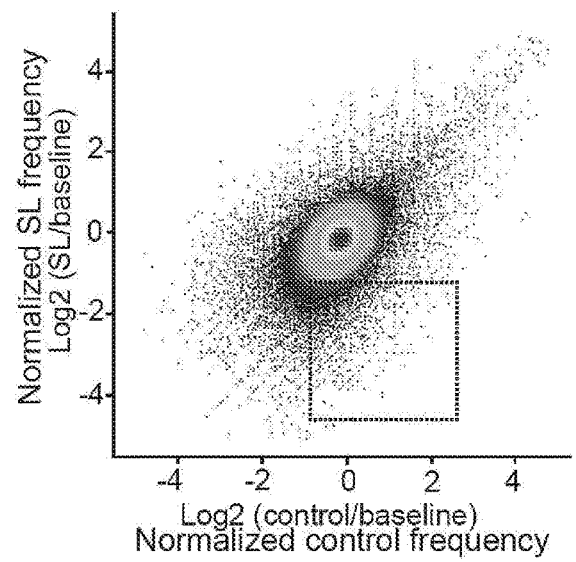

FIG. 1, Panel D
| p-value | Pathways | Hits/Total |
|---|---|---|
| 2.1E-13 | Ribosome biogenesis | 32/135 |
| 8.0E-12 | RNA transport | 34/171 |
| 3.5E-09 | Transcription/RNA polymerase | 5/45 |
| 1.7E-07 | Aminoacyl-tRNA biosynthesis | 6/66 |
| 3.0E-07 | Pyrimidine metabolism | 20/104 |
| 3.4E-07 | Cell cycle and DNA replication | 22/124 |
| 4.7E-07 | DNA repair | 11/36 |
| 1.2E-06 | Spliceosome | 22/133 |
| 6.1E-05 | mRNA surveillance/degradation | 15/91 |
| 4.6E-03 | Terpenoid backbone biosynthesis | 5/22 |
FIG. 2, Panel A
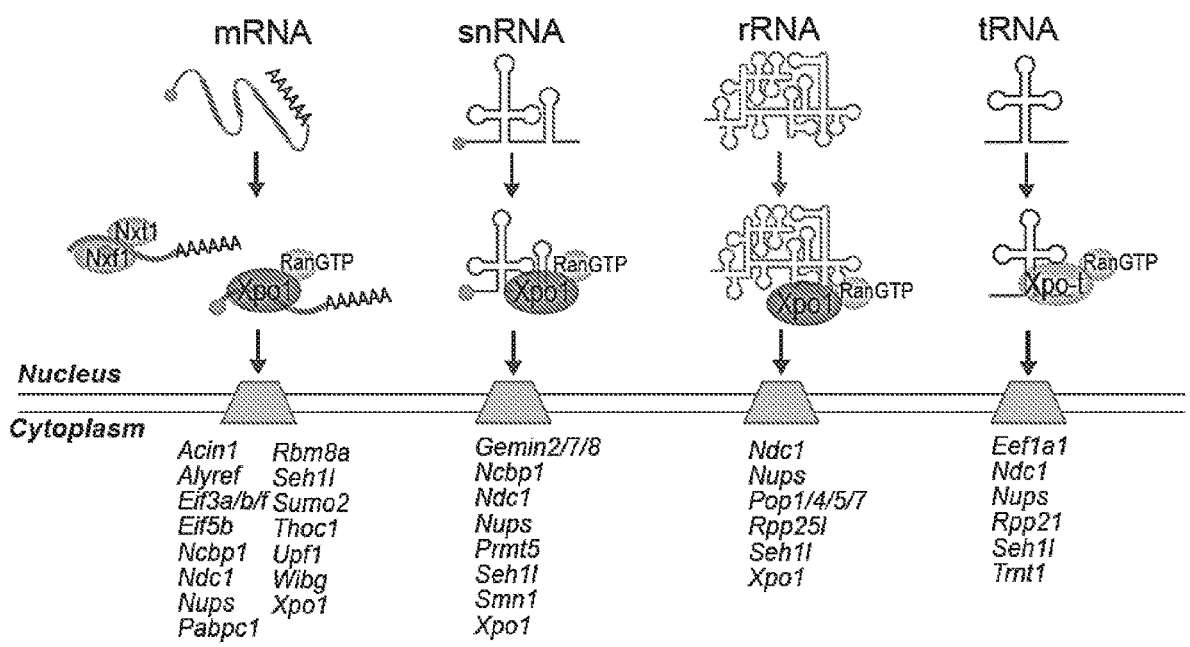

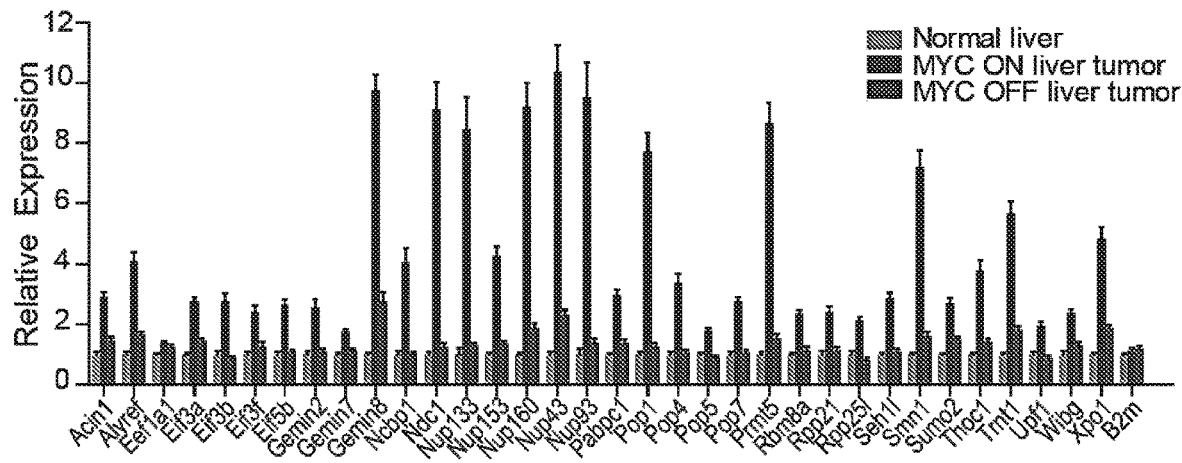
FIG. 2, Panel B
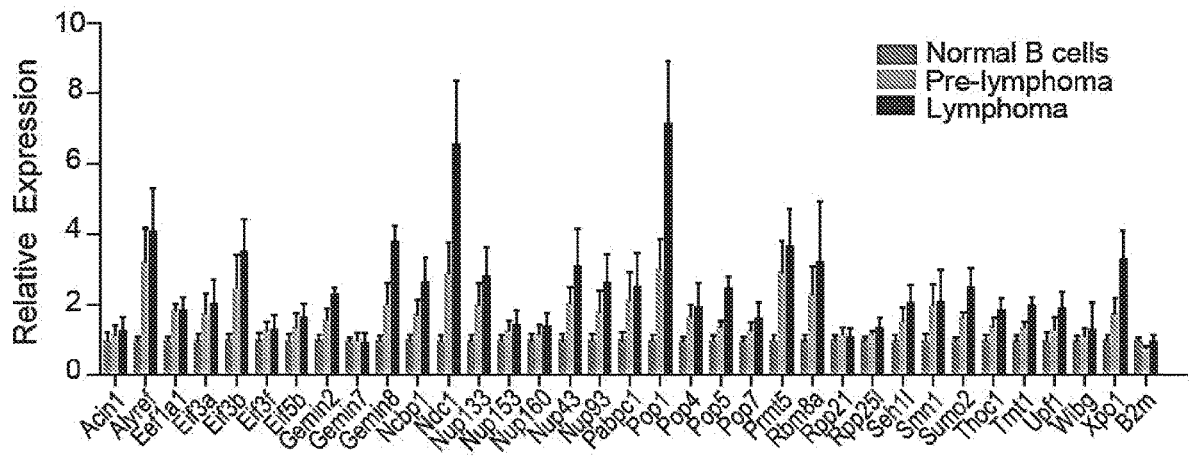
FIG. 2, Panel C
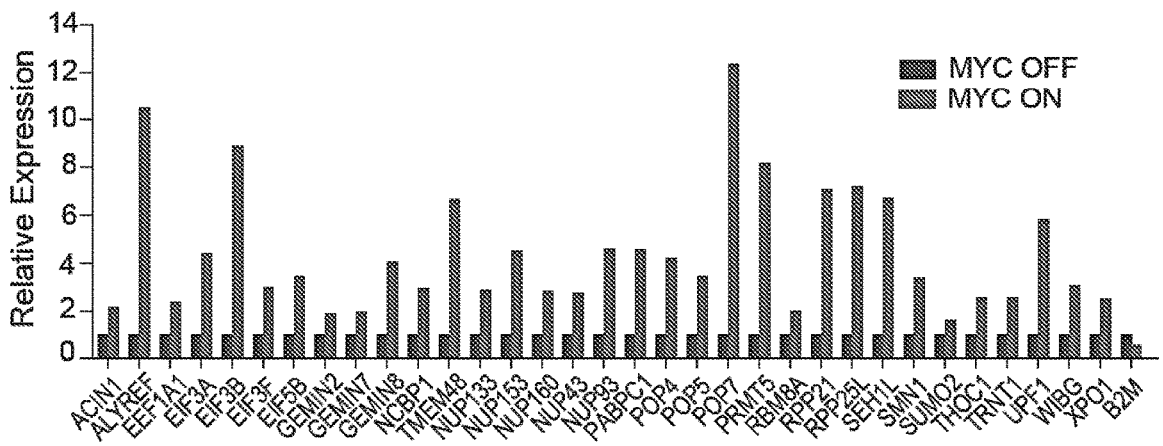
FIG. 2, Panel D

FIG. 3, Panel A
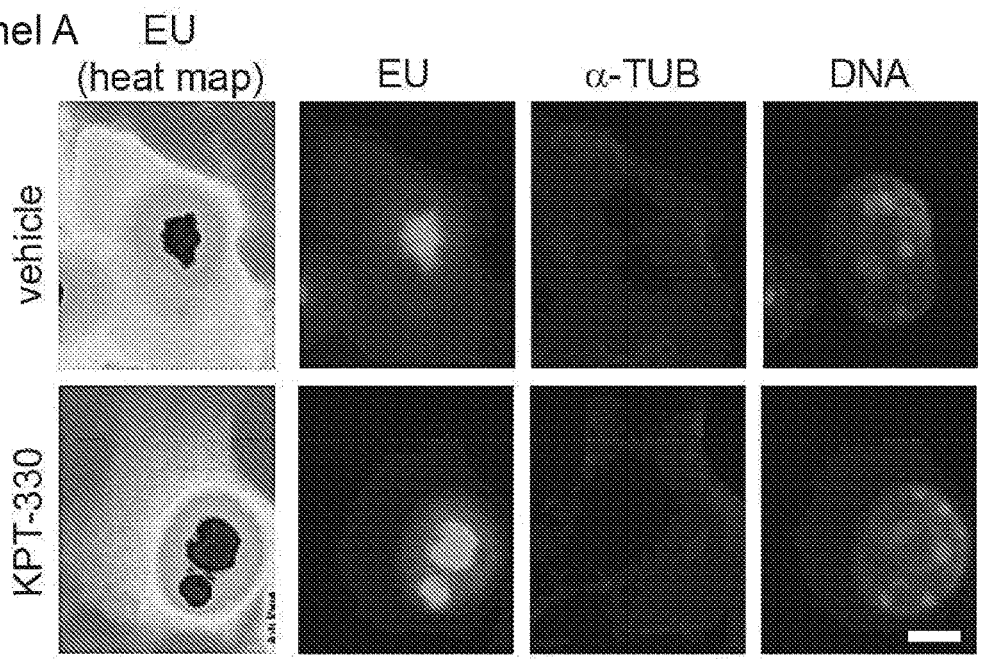
FIG. 3, Panel B
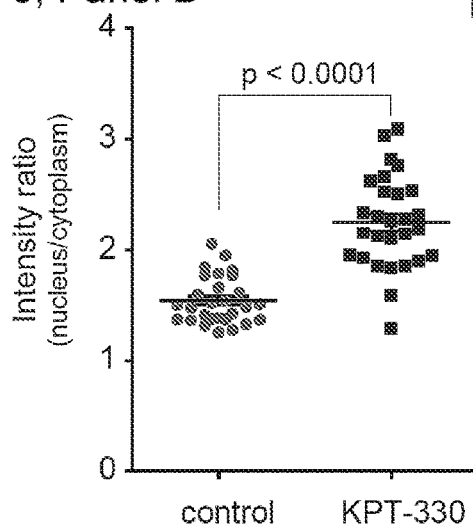
FIG. 4, Panel A
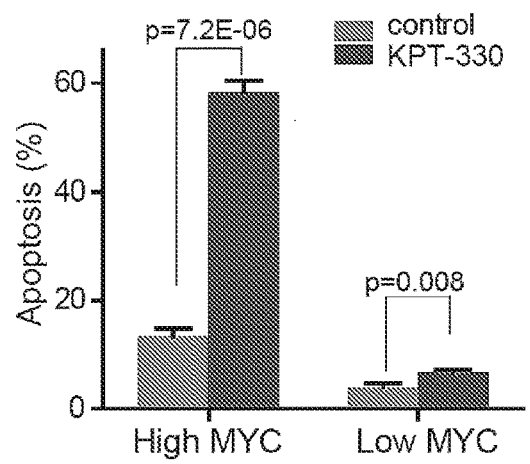
FIG. 4, Panel B
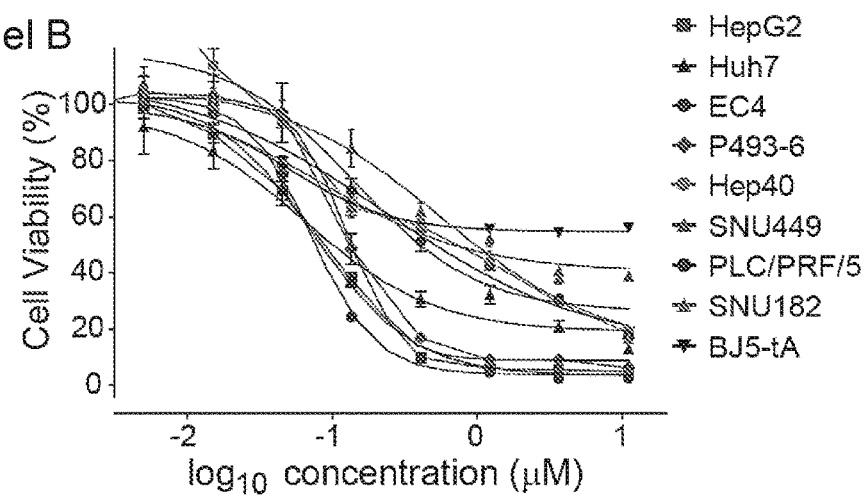

FIG. 4, Panel C
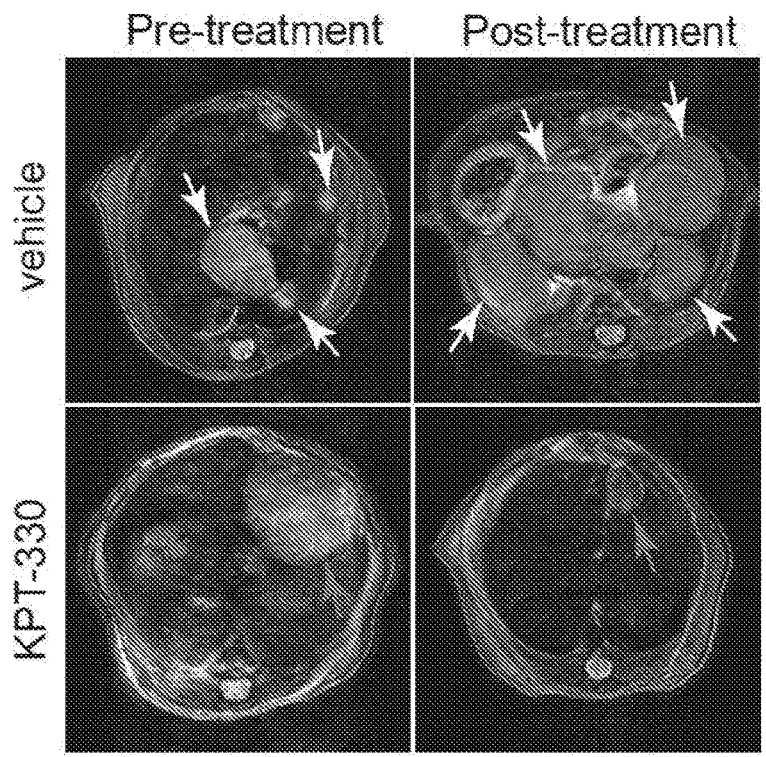
FIG. 4, Panel D
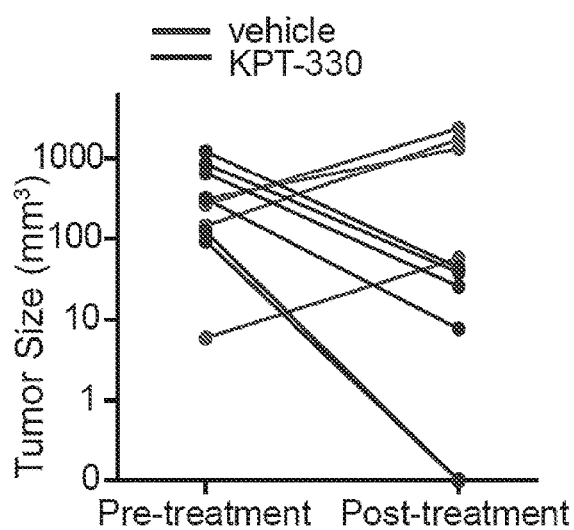
FIG. 4, Panel E
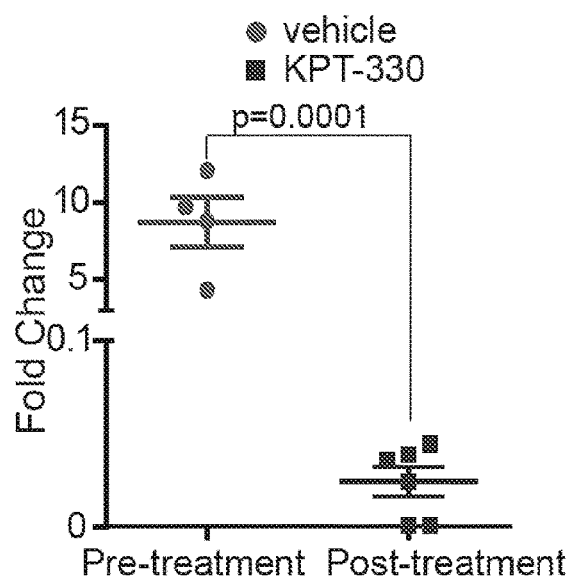

FIG. 4, Panel F
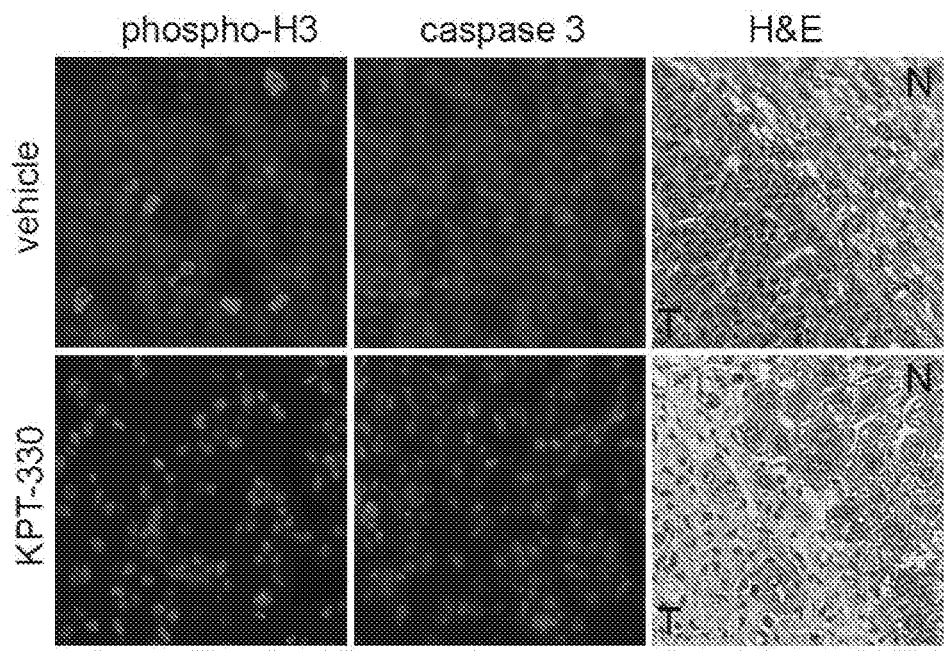
FIG. 4, Panel G
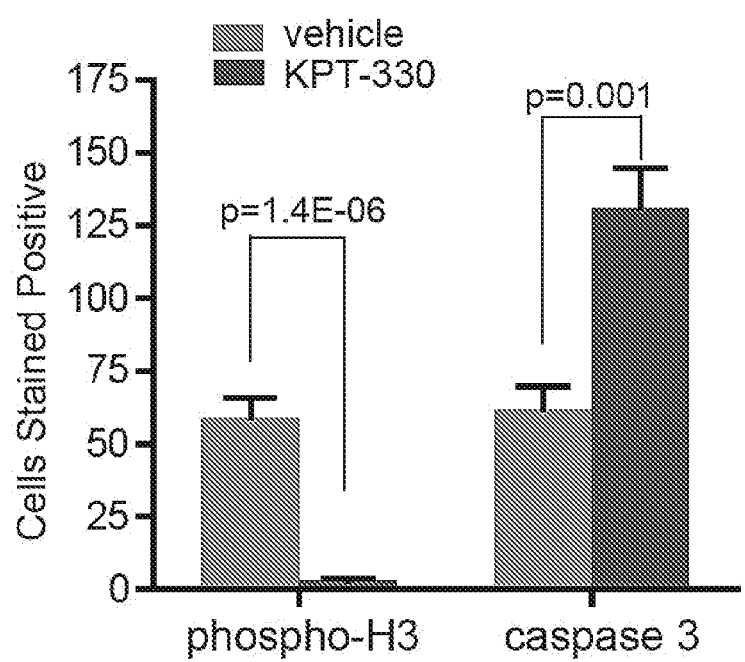

FIG. 5
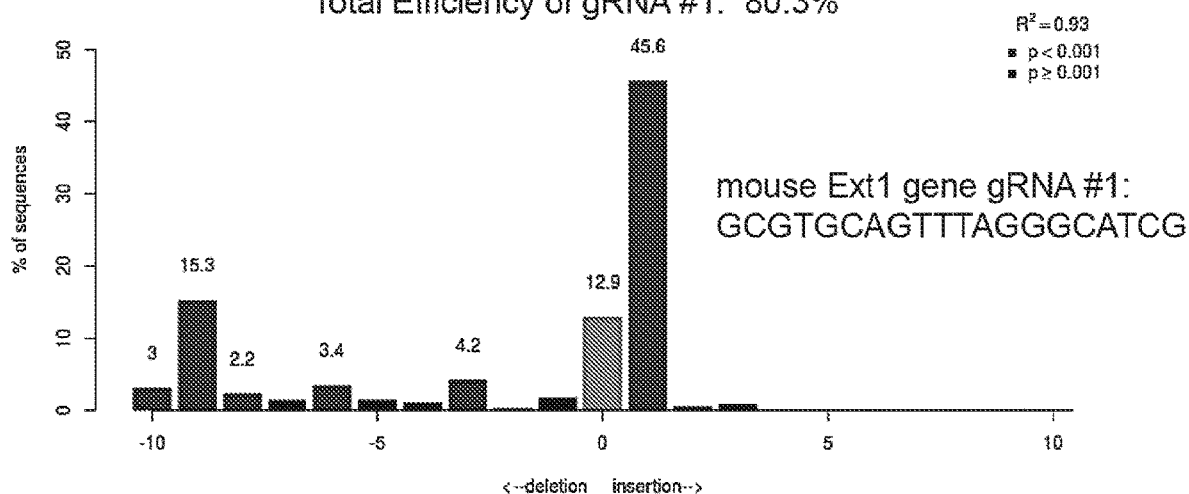
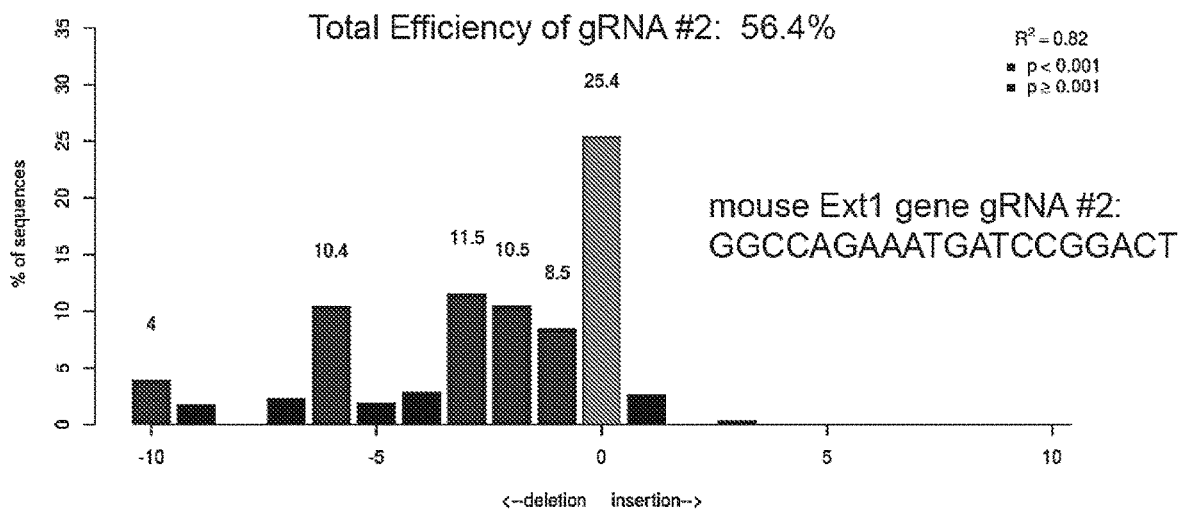

FIG. 6, Panel A
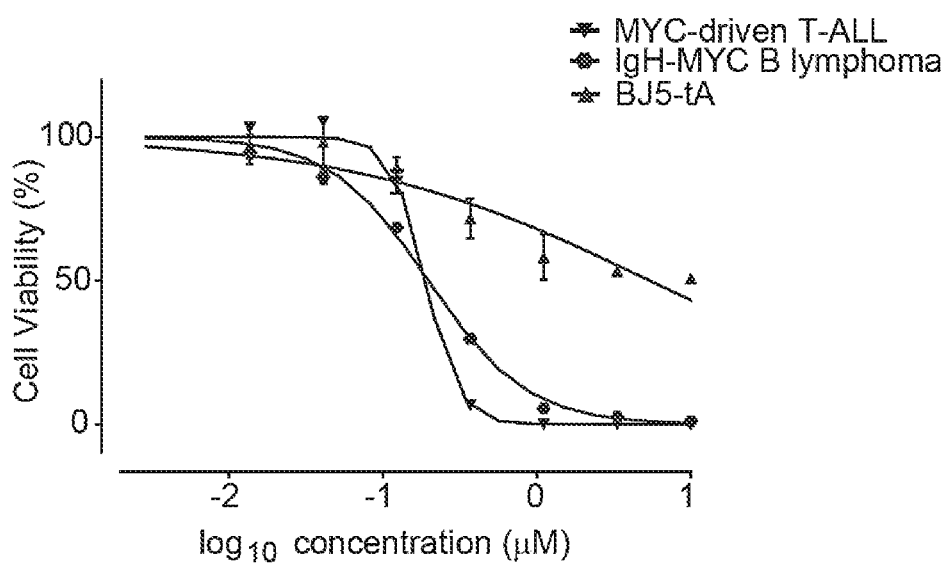
FIG. 6, Panel B
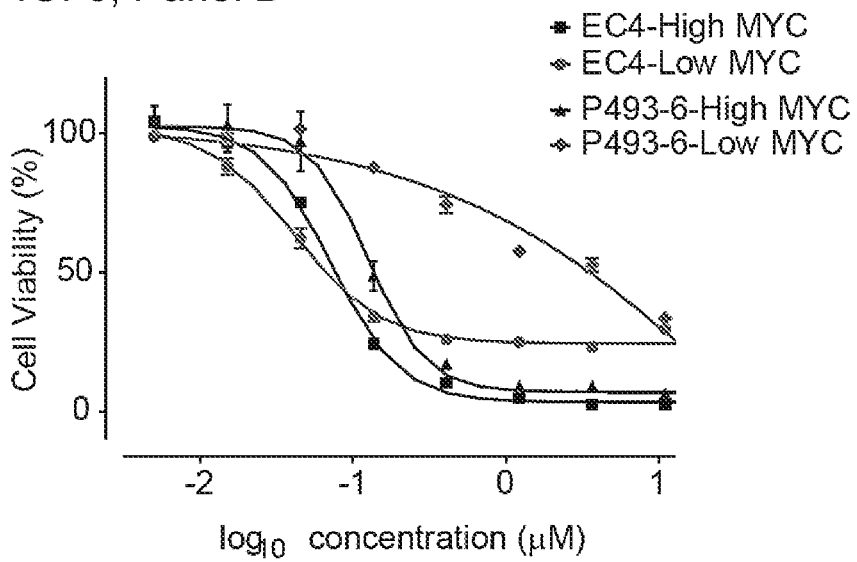

TARGET GENES IN MYC-DRIVEN NEOPLASIA

CROSS-REFERENCE

This application claims benefit of U.S. Provisional Patent Application No. 62/442,260, filed Jan. 4, 2017, which application is incorporated herein by reference in its entirety.

GOVERNMENT RIGHTS

This invention was made with Government support under contracts CA089305, CA114747, CA149145, CA170378, CA184384, and CA188383 awarded by the National Institutes of Health. The Government has certain rights in the invention.

INCORPORATION BY REFERENCE OF SEQUENCE LISTING PROVIDED AS A TEXT FILE

A Sequence Listing is provided herewith as a text file, "STAN-1359WO_SeqList_ST25.txt" created on Dec. 20, 2017 and having a size of 1,161 KB. The contents of the text file are incorporated by reference herein in their entirety.

BACKGROUND

MYC is a master transcription factor that can regulate the expression of up to 15% of genes in the genome[1,2]. Overexpression of MYC is thought to contribute to the pathogenesis of over 50% of human cancers[3]. Experimentally, the inhibition of MYC reverses tumorigenesis in transgenic mouse models[4-6]. Therapeutically targeting MYC would have broad clinical impact across multiple cancer types. However, identifying small molecules that directly target MYC has been extremely challenging[7,8]. The structure of MYC lacks any druggable domains, and as a result it has been impossible to design compounds that cleanly hit the protein[9].

An alternative approach to directly targeting MYC is to target genes that are specifically relied upon by MYC-addicted cancers, but otherwise do not result in adverse effects within cells not addicted to MYC, such as non-cancer cells. Attempts to identify such targets, referred to as synthetic lethals, have previously employed methods of screening that rely on incomplete inhibition of target genes, such as RNA interference (RNAi).

The identification of additional druggable targets, for example, through the use of improved methods of screening for synthetic lethal targets in MYC-driven cancers that result in complete inhibition of target genes, will increase the development of effective cancer therapeutics. Furthermore, treating subjects having cancers that are specifically identified as MYC-addicted with such new therapeutics circumvents the issues associated with the undruggability of MYC. This approach specifically takes advantage of the very element of these cancers that significantly contributes to pathogenesis, namely MYC overexpression.

Publications

1 Patel, J. H., et al. *Nature reviews. Cancer* 4, 562-568, (2004).
2 Li, Z. et al. *Proc. Nat. Acad. Sci. USA* 100, 8164-8169, (2003).
3 Dang, C. V. *Cell* 149, 22-35 (2012).
4 Felsher, D. W. & Bishop, J. M. *Mol Cell* 4, 199-207 (1999).
5 Jain, M. et al. *Science* 297, 102-104, (2002).
6 Soucek, L. et al. *Nature* 455, 679-683, (2008).
7 Lazo, J. S. & Sharlow, E. R. *Ann. Rev. Pharm. Tox.* 56, 23-40, (2016).
8 Soucek, L. & Evan, G. I. *Cur. Op. Gen. Dev.* 20, 91-95, (2010).
9 Martz, L. *SciBX* 5(27), (2012).

SUMMARY

Methods are provided for treating a subject having a MYC-driven neoplasia. Aspects of the methods include administering to the subject an amount of an inhibitor of a target gene effective to treat the subject for the MYC-driven neoplasia. Methods are also provided for identifying a MYC-dependent target gene in a MYC-driven neoplasia. Aspects of the method include identifying the MYC-dependent target gene based on a phenotype detected in a first tumor cell line conditionally expressing MYC that is absent or quantitatively different in a second tumor cell line conditionally repressing MYC when the two cell lines are contacted with a CRISPR-based gene silencing agent. Kits and cell lines for practicing the methods of the disclosure are also provided.

BRIEF DESCRIPTION OF THE DRAWINGS

The invention is best understood from the following detailed description when read in conjunction with the accompanying drawings. It is emphasized that, according to common practice, the various features of the drawings are not to-scale. On the contrary, the dimensions of the various features are arbitrarily expanded or reduced for clarity. Included in the drawings are the following figures.

FIG. 1 (Panels a-d). CRISPR-based genome-wide screen identifies MYC synthetic lethal targets. Panel a, The design of the CRISPR-based screen of MYC synthetic lethal interactions. MYC level in the EC4 cell line is regulated by the Tet-Off system. After splitting the baseline pool into the SL and control pools, the control pool was treated with doxycycline (DOX) to shut off MYC expression while the SL pool continued to overexpress MYC. The horizontal bars above each plate are representative of the frequency of gRNAs in the pool. Panel b, Box plots showing the log 2 transformed gRNA frequency in each pool. The box represents the 25th percentile, median, and 75th percentile. The whiskers represent 1.5 multiplied by the interquartile range. Panel c, Comparison of the SL versus control pool for the identification of specific synthetic lethal dropouts. The gRNA frequency in the SL and control pools were both normalized by their frequency in the baseline pool. The normalized frequency was log 2 transformed and plotted. The specific gRNA dropouts were defined by at least two-fold decrease in frequency in the SL pool but not in the control pool (rectangular box with dashed line). Panel d, Pathways analysis of the synthetic lethal target genes using the KEGG database. The number of specific hits from the screen and the total number of genes in the pathway were shown in the right column.

FIG. 2 (Panels a-d). Expression of the 34 MYC synthetic lethal genes involved in RNA transport is regulated by MYC in multiple tumor types. Panel a, The function involvement of the 34 genes in the transport of specific RNA species. Note that Xpo1 participates in the transport of mRNAs, snRNAs, and rRNAs. Panel b, The transcript level of 34

Figure 7:
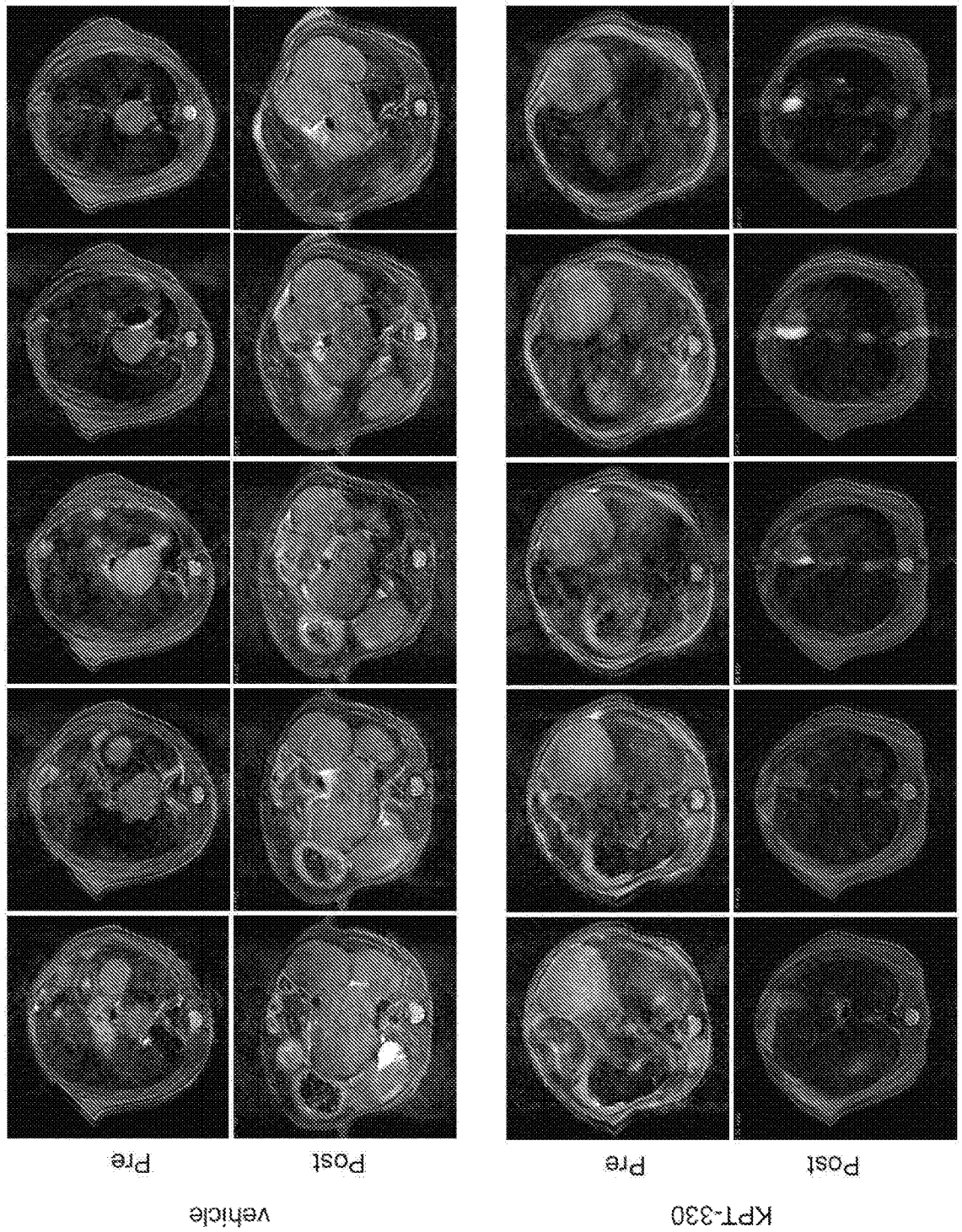

RNA transport genes in normal liver (left bar, n=11), liver tumors with MYC overexpression (middle bar, n=16), and liver tumors with MYC shut off (right bar, n=8) isolated from the LAP-tTA/tet-O-MYC mouse model. The data were derived from the publicly available RNA-seq data set GSE76062. Data were presented as mean±SEM of FPKM of the transcript of each gene. Panel c, The transcript level of 34 RNA transport genes during the lymphomagenesis in the Eµ-MYC mouse model. The data for B lymphocytes (n=4), pre-lymphoma (n=4), and lymphoma (n=3) were from the publicly available RNA-seq data set GSE51008. Data were presented as mean±SEM of FPKM of each gene. Panel d, The transcript level of 34 RNA transport genes in the Tet-regulated human Burkitt lymphoma-like P493-6 cell line with either MYC ON or MYC OFF. Data were presented as the Fragments Per Kilobase of transcript per Million mapped reads (FPKM). Only one sample each exists for the MYC ON and MYC OFF conditions in the publicly available RNA-seq data set GSE40783.

FIG. 3 (Panels a-b). Xpo1 inhibition with KPT-330 suppresses RNA transportation in cancer cells overexpressing MYC. Panel a, Imaging of total RNA in EC4 cells treated with either DMSO vehicle control or KPT-330. Total RNA was labeled with EU and followed by imaging with the Click-IT imaging kit. Staining of tubulin and DNA were used as internal controls. The EU labeling was also shown in the heat map to better visualize the RNA distribution. Panel b, Quantification of RNA abundance in the nucleus versus cytoplasm as shown in Panel a. The p value for the two-tailed Student's t test is shown.

FIG. 4 (Panels a-g). Xpo1 is a potential druggable target for cancers overexpressing MYC. Panel a, Apoptosis of EC4 cells treated with DMSO or KPT-330 under either high MYC or low MYC conditions. The rate of apoptosis was measured by flow cytometric analysis after 7-AAD/Annexin V staining. Each treatment was performed in triplicates. The p values for the two-tailed Student's t test are shown in the figure. Panel b, IC50 determination for cancer cell lines with high MYC versus low MYC expression. Panel c, MRI scan of liver tumors in the LAP-tTA/tet-O-MYC mice treated with vehicle (n=4) or KPT-330 (n=6). Mice were treated for 6 doses total. The tumor nodules on the MRI images were indicated by arrows. Panel d, Changes in liver tumor volume in LAP-tTA/tet-O-MYC mice treated with vehicle or KPT-330 (6 doses). Panel e, Relative fold change in tumor volume as presented in Panel d. The p value for the two-tailed Student's t test is shown. Panel f, Immunofluorescence staining of phospho-histone H3 and cleaved-caspase 3 in liver tumors treated with either vehicle or KPT-330 (3 doses). Histological changes in tumors (T) and adjacent normal liver tissues (N) were shown by H&E staining. Samples were collected from three mice in each group. Panel g, Quantification of Immunofluorescence phospho-histone H3 and cleaved-caspase 3 in liver tumors treated with either vehicle or KPT-330 (3 doses). The p value for two-tailed Student's t test is shown.

FIG. 5. Functionally confirms the effectiveness of Cas9 nuclease induced mutations at representative specific genomic loci. From top to bottom, SEQ ID NOs:1-2.

FIG. 6 (Panels a-b). IC50 determination for cancer cell lines with high MYC versus low MYC expression (Panel a, MYC-driven T cell acute lymphoblastic leukemia and MYC-driven B cell lymphoma; Panel b, P493-6 Burkitt lymphoma and EC4 cells in high and low MYC expressing conditions).

FIG. 7. MRI images pertaining to FIG. 4, Panels c-e.

Figure 8:
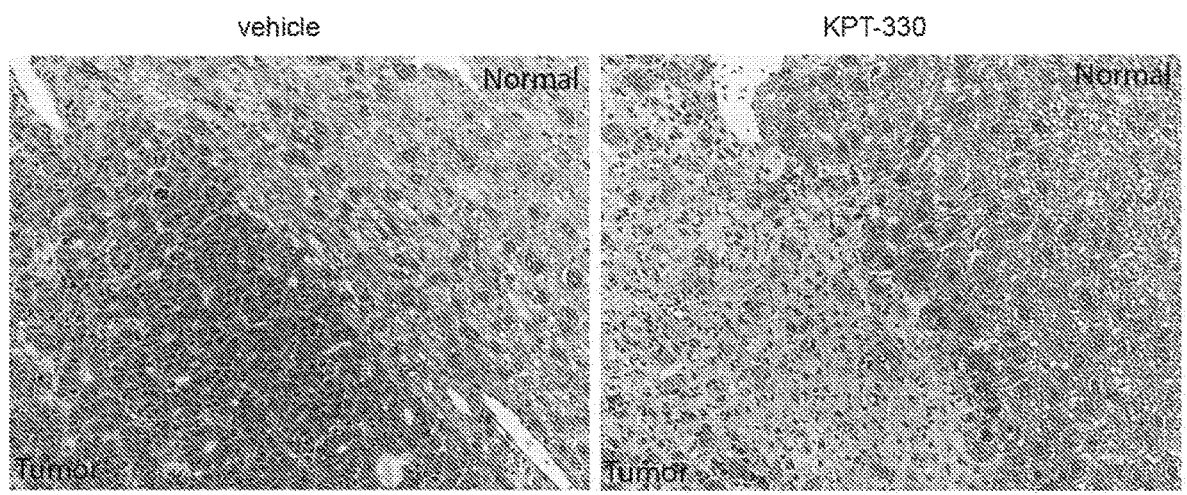

FIG. 8. Histological images showing only sporadic tumor cells left in mice with Xpo1 inhibition as compared to control.

DEFINITIONS

The terms "specific binding," "specifically binds," and the like, refer to non-covalent or covalent preferential binding to a molecule relative to other molecules or moieties in a solution or reaction mixture (e.g., an antibody specifically binds to a particular polypeptide or epitope relative to other available polypeptides). In some embodiments, the affinity of one molecule for another molecule to which it specifically binds is characterized by a $K_D$ (dissociation constant) of $10^{-5}$ M or less (e.g., $10^{-6}$ M or less, $10^{-7}$ M or less, $10^{-8}$ M or less, $10^{-3}$ M or less, $10^{-10}$ M or less, $10^{-11}$ M or less, $10^{-12}$ M or less, $10^{-13}$ M or less, $10^{-14}$ M or less, $10^{-15}$ M or less, or $10^{-16}$ M or less). "Affinity" refers to the strength of binding, increased binding affinity being correlated with a lower $K_D$.

The terms "antibody" and "immunoglobulin", as used herein, are used interchangeably may generally refer to whole or intact molecules or fragments thereof and modified and/or conjugated antibodies or fragments thereof that have been modified and/or conjugated. The immunoglobulins can be divided into five different classes, based on differences in the amino acid sequences in the constant region of the heavy chains. All immunoglobulins within a given class will have very similar heavy chain constant regions. These differences can be detected by sequence studies or more commonly by serological means (i.e. by the use of antibodies directed to these differences). Immunoglobulin classes include IgG (Gamma heavy chains), IgM (Mu heavy chains), IgA (Alpha heavy chains), IgD (Delta heavy chains), and IgE (Epsilon heavy chains).

Antibody or immunoglobulin may refer to a class of structurally related glycoproteins consisting of two pairs of polypeptide chains, one pair of light (L) low molecular weight chains and one pair of heavy (H) chains, all four inter-connected by disulfide bonds. The structure of immunoglobulins has been well characterized, see for instance Fundamental Immunology Ch. 7 (Paul, W., ed., 2nd ed. Raven Press, N.Y. (1989)). Briefly, each heavy chain typically is comprised of a heavy chain variable region (abbreviated as $V_H$) and a heavy chain constant region (abbreviated as $C_H$). The heavy chain constant region typically is comprised of three domains, $C_H1$, $C_H2$, and $C_H3$. Each light chain typically is comprised of a light chain variable region (abbreviated as $V_L$) and a light chain constant region (abbreviated herein as $C_L$). The light chain constant region typically is comprised of one domain, $C_L$. The $V_H$ and $V_L$ regions may be further subdivided into regions of hypervariability (or hypervariable regions which may be hypervariable in sequence and/or form of structurally defined loops), also termed complementarity determining regions (CDRs), interspersed with regions that are more conserved, termed framework regions (FRs).

Whole or largely intact antibodies are generally multivalent, meaning they may simultaneously bind more than one molecule of antigen whereas antibody fragments may be monovalent. Antibodies produced by an organism as part of an immune response are generally monospecific, meaning they generally bind a single species of antigen. Multivalent monospecific antibodies, i.e. antibodies that bind more than one molecule of a single species of antigen, may bind a single antigen epitope (e.g., a monoclonal antibody) or multiple different antigen epitopes (e.g., a polyclonal antibody).

Multispecific (e.g., bispecific) antibodies, which bind multiple species of antigen, may be readily engineered by those of ordinary skill in the art and, thus, may be encompassed within the use of the term "antibody" used herein where appropriate. Also, multivalent antibody fragments may be engineered, e.g., by the linking of two monovalent antibody fragments. As such, bivalent and/or multivalent antibody fragments may be encompassed within the use of the term "antibody", where appropriate, as the ordinary skilled artisan will be readily aware of antibody fragments, e.g., those described below, which may be linked in any convenient and appropriate combination to generate multivalent monospecific or polyspecific (e.g., bispecific) antibody fragments.

Antibody fragments include but are not limited to antigen-binding fragments (Fab or F(ab), including Fab' or F(ab'), (Fab)$_2$, F(ab')$_2$, etc.), single chain variable fragments (scFv or Fv), "third generation" (3G) molecules, etc. which are capable of binding the epitopic determinant. These antibody fragments retain some ability to selectively bind to the subject antigen, examples of which include, but are not limited to:

(1) Fab, the fragment which contains a monovalent antigen-binding fragment of an antibody molecule can be produced by digestion of whole antibody with the enzyme papain to yield an intact light chain and a portion of one heavy chain;

(2) Fab', the fragment of an antibody molecule can be obtained by treating whole antibody with pepsin, followed by reduction, to yield an intact light chain and a portion of the heavy chain; two Fab' fragments are obtained per antibody molecule;

(3) (Fab)$_2$, the fragment of the antibody that can be obtained by treating whole antibody with the enzyme pepsin without subsequent reduction;

(4) F(ab)$_2$ is a dimer of two Fab' fragments held together by two disulfide bonds;

(5) Fv, defined as a genetically engineered fragment containing the variable region of the light chain and the variable region of the heavy chain expressed as two chains;

(6) Single chain antibody ("SCA"), defined as a genetically engineered molecule containing the variable region of the light chain, the variable region of the heavy chain, linked by a suitable polypeptide linker as a genetically fused single chain molecule; such single chain antibodies may be in the form of multimers such as diabodies, triabodies, tetrabodies, etc. which may or may not be polyspecific (see, for example, WO 94/07921 and WO 98/44001) and (7) "3G", including single domain (typically a variable heavy domain devoid of a light chain) and "miniaturized" antibody molecules (typically a full-sized Ab or mAb in which non-essential domains have been removed).

The terms "treatment", "treating", "treat" and the like are used herein to generally refer to obtaining a desired pharmacologic and/or physiologic effect. The effect can be prophylactic in terms of completely or partially preventing a disease or symptom(s) thereof and/or may be therapeutic in terms of a partial or complete stabilization or cure for a disease and/or adverse effect attributable to the disease. The term "treatment" encompasses any treatment of a disease in a mammal, particularly a human, and includes: (a) preventing the disease and/or symptom(s) from occurring in a subject who may be predisposed to the disease or symptom(s) but has not yet been diagnosed as having it; (b) inhibiting the disease and/or symptom(s), i.e., arresting development of a disease and/or the associated symptoms; or (c) relieving the disease and the associated symptom(s), i.e., causing regression of the disease and/or symptom(s). Those in need of treatment can include those already inflicted (e.g., those with cancer, e.g. those having tumors) as well as those in which prevention is desired (e.g., those with increased susceptibility to cancer; those with cancer; those suspected of having cancer; etc.).

The terms "recipient", "individual", "subject", "host", and "patient", are used interchangeably herein and refer to any mammalian subject for whom diagnosis, treatment, or therapy is desired, particularly humans. "Mammal" for purposes of treatment refers to any animal classified as a mammal, including humans, domestic and farm animals, and zoo, sports, or pet animals, such as dogs, horses, cats, cows, sheep, goats, pigs, camels, etc. In some embodiments, the mammal is human.

The terms "co-administration" and "in combination with" include the administration of two or more therapeutic agents either simultaneously, concurrently or sequentially within no specific time limits. In one embodiment, the agents are present in the cell or in the subjects body at the same time or exert their biological or therapeutic effect at the same time. In one embodiment, the therapeutic agents are in the same composition or unit dosage form. In other embodiments, the therapeutic agents are in separate compositions or unit dosage forms. In certain embodiments, a first agent can be administered prior to (e.g., minutes, 15 minutes, 30 minutes, 45 minutes, 1 hour, 2 hours, 4 hours, 6 hours, 12 hours, 24 hours, 48 hours, 72 hours, 96 hours, 1 week, 2 weeks, 3 weeks, 4 weeks, 5 weeks, 6 weeks, 8 weeks, or 12 weeks before), concomitantly with, or subsequent to (e.g., 5 minutes, 15 minutes, 30 minutes, 45 minutes, 1 hour, 2 hours, 4 hours, 6 hours, 12 hours, 24 hours, 48 hours, 72 hours, 96 hours, 1 week, 2 weeks, 3 weeks, 4 weeks, 5 weeks, 6 weeks, 8 weeks, or 12 weeks after) the administration of a second therapeutic agent.

A "therapeutically effective amount", a "therapeutically effective dose" or "therapeutic dose" is an amount sufficient to effect desired clinical results (i.e., achieve therapeutic efficacy, achieve a desired therapeutic response, etc.). A therapeutically effective dose can be administered in one or more administrations. For purposes of this disclosure, a therapeutically effective dose of an agent that inhibits a target gene (e.g., a MYC-dependent target gene, and the like) and/or compositions is an amount that is sufficient, when administered to the individual, to palliate, ameliorate, stabilize, reverse, prevent, slow or delay the progression of the disease state (e.g., cancer, etc.) by, for example, inhibiting the growth of, inducing death of or otherwise preventing the clinical progressing of a MYC-dependent cancer present in the subject.

DETAILED DESCRIPTION

Methods are provided for treating a subject having a MYC-driven neoplasia. Aspects of the methods include administering to the subject an amount of an inhibitor of a target gene effective to treat the subject for the MYC-driven neoplasia. Methods are also provided for identifying a MYC-dependent target gene in a MYC-driven neoplasia. Aspects of the method include identifying the MYC-dependent target gene based on a phenotype detected in a first tumor cell line conditionally expressing MYC that is absent or quantitatively different in a second tumor cell line conditionally repressing MYC when the two cell lines are contacted with a CRISPR-based gene silencing agent. Kits and cell lines for practicing the methods of the disclosure are also provided.

Before the present methods and compositions are described, it is to be understood that this invention is not limited to particular method or composition described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limits of that range is also specifically disclosed. Each smaller range between any stated value or intervening value in a stated range and any other stated or intervening value in that stated range is encompassed within the invention. The upper and lower limits of these smaller ranges may independently be included or excluded in the range, and each range where either, neither or both limits are included in the smaller ranges is also encompassed within the invention, subject to any specifically excluded limit in the stated range. Where the stated range includes one or both of the limits, ranges excluding either or both of those included limits are also included in the invention.

Unless defined otherwise, all technical and scientific terms used herein have the same meaning as commonly understood by one of ordinary skill in the art to which this invention belongs. Although any methods and materials similar or equivalent to those described herein can be used in the practice or testing of the present invention, some potential and preferred methods and materials are now described. All publications mentioned herein are incorporated herein by reference to disclose and describe the methods and/or materials in connection with which the publications are cited. It is understood that the present disclosure supersedes any disclosure of an incorporated publication to the extent there is a contradiction.

As will be apparent to those of skill in the art upon reading this disclosure, each of the individual embodiments described and illustrated herein has discrete components and features which may be readily separated from or combined with the features of any of the other several embodiments without departing from the scope or spirit of the present invention. Any recited method can be carried out in the order of events recited or in any other order which is logically possible.

It must be noted that as used herein and in the appended claims, the singular forms "a", "an", and "the" include plural referents unless the context clearly dictates otherwise. Thus, for example, reference to "a cell" includes a plurality of such cells and reference to "the peptide" includes reference to one or more peptides and equivalents thereof, e.g. polypeptides, known to those skilled in the art, and so forth.

The publications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed.

Methods

As summarized above, methods of the present disclosure include methods of identifying a MYC-dependent target gene. Aspects of such methods generally include contacting two neoplastic cell lines (e.g., two cancer cell lines, two tumor cell lines, etc.), one conditionally expressing MYC and one conditionally repressing MYC, with a CRISPR-based gene silencing agent targeting a target gene and identifying one or more phenotypes differentially induced in the two different neoplastic cell lines. Accordingly, the subject methods identify target genes that, when targeted with a CRISPR-based gene silencing agent, result in a MYC-dependent phenotype. A MYC-dependent phenotype may be correlated with the gene targeted by the CRISPR-based gene silencing agent, allowing the identification of the targeted gene as a MYC-dependent target gene.

MYC-dependent phenotypes will vary and, in some instances, may include MYC-dependent death of a cell or cells of a MYC-expressing neoplastic cell line. MYC-dependent death of a cell or cells of the MYC-expressing neoplastic cell line may be determined in any convenient method including e.g., by comparison with the rate of cell death or viability/survival of a cell or cells of a corresponding MYC-repressing neoplastic cell line. In instances where the identified MYC-dependent phenotype includes increased cell death or decreased viability of the cells expressing MYC, as compared to control cells where MYC is repressed, the identified phenotype may be referred to as a synthetic lethal phenotype. Such synthetic lethal phenotypes will generally include where the reduced expression of a target gene, through targeting with a CRISPR-based gene silencing agent, results in decreased viability of MYC expressing cells but does not (or insignificantly) results in a decrease in viability of cells which do not express MYC, repress MYC or otherwise express MYC at a level below that of the MYC expressing cells. Target genes identified as resulting in a MYC-dependent synthetic lethality may be referred to as MYC-dependent synthetic lethal target genes.

By "MYC-dependent target gene", as used herein, is meant a gene, targeted by a CRISPR-based gene silencing agent, which results in a MYC-dependent phenotype. In some instances, identified MYC-dependent target genes may be further targeted in the treatment of a subject, as described in more detail below, utilizing various agents that target the target gene, including e.g., agents that target the activity of the target gene, agents that specifically bind an encoded product of the target gene to inhibit its activity, agents that inhibit the expression of the target gene, and the like. Accordingly, the term "target gene" as used herein may refer to the targeting of the CRISPR-based gene silencing agent to the target gene and/or the targeting of a therapeutic to the target gene or an expression product thereof.

Methods of the present disclosure may be employed to identify synthetic lethal interactions with MYC thereby identifying MYC-synthetic lethal genes. An identified MYC-synthetic lethal gene may be a MYC-dependent target gene. The expression of MYC-dependent target genes, as defined herein, may or may not be directly or indirectly controlled by MYC. For example, in some instances, a MYC-dependent target gene may be a direct target of MYC such that MYC directly controls the expression of the target gene. In some instances, a MYC-dependent target gene may be an indirect target of MYC such that MYC indirectly controls the expression of the target gene. In some instances, a MYC-dependent target gene may not be a direct or indirect target of MYC such that MYC does not directly or indirectly control the expression of the target gene. Such a target gene having expression that is not directly or indirectly controlled by MYC may nonetheless represent a MYC synthetic lethal interaction and be a MYC-synthetic lethal gene that is identified by the methods described herein. Accordingly, the MYC-synthetic lethal genes and the MYC-dependent target genes identified using the methods described herein will not be limited to genes conventionally identified as targets of MYC (i.e., MYC target genes) and will include both genes that are and are not direct and/or indirect targets of MYC (i.e., MYC target genes).

By "CRISPR-based gene silencing agent" is meant one or more agents that when delivered to a cell cause the directed silencing of a target gene by CRISPER/Cas9-based nuclease activity. Accordingly, in some instances, a CRISPR-based gene silencing agent may include a guide RNA (gRNA) having sequence that specifically targets a Cas9 nuclease to a specific target gene. CRISPR/Cas9-based silencing of a target gene may include delivery of a Cas9 polypeptide or a Cas9 polypeptide encoding nucleic acid to the subject cells. For example, in some instances, a vector that includes a nucleic acid that encodes a Cas9 nuclease may be delivered to the subject cells before, during or after the cell is contacted with a CRISPR-based gene silencing agent such that the encoded Cas9 nuclease is expressed when the CRISPR-based gene silencing agent is present within the cell. In some instances, the cell may be genetically modified with a nucleic acid encoding a Cas9 nuclease such that the encoded Cas9 nuclease is expressed (e.g., conditionally expressed, constitutively expressed, etc.) when the CRISPR-based gene silencing agent is present within the cell. Accordingly, CRISPR/Cas9-based silencing of the present methods may employ a Cas9 nuclease that is stably or transiently expressed including e.g., where a nucleic acid encoding the Cas9 nuclease is transiently or stably present within the cell line. In some instances, Cas9 polypeptide may be delivered to the subject cells, i.e., without the need to express the Cas9 polypeptide within the cells. CRISPR-based gene silencing agents will vary and may include e.g., vector (e.g., virus (e.g., lentivirus), plasmid, etc.) containing and/or expressing one or more gRNAs. Methods of delivery of CRISPR-based gene silencing agents will similarly vary any may include e.g., transfection, electroporation, lipofection, etc.

CRISPR-based gene silencing agents of the present disclosure may be directed to essentially any element of a subject genome including e.g., protein-coding and non-protein coding elements of the subject genome. In some instances, e.g., where a plurality of CRISPR-based gene silencing agents is employed, the plurality of CRISPR-based gene silencing agents may collectively target all or essentially all genes of the subject genome (i.e., genome-wide targeting). In some instances, targeted non-protein coding elements may include but are not limited to e.g., promoters, enhancers, non-coding RNAs, and the like. In some instances, the targets of one or more CRISPR-based gene silencing agents may include proteins involved in RNA metabolism and/or nucleic acids encoding proteins involved in RNA metabolism. Proteins involved in RNA metabolism include but are not limited to e.g., proteins involved in RNA transcription amplification, mRNA splicing, ribosomal biogenesis, RNA transport, RNA degradation and the like. In some instances, the targets of one or more CRISPR-based gene silencing agents may include proteins involved in processes other than RNA metabolism including but not limited to e.g., DNA repair, pyrimidine metabolism, terpenoid backbone biosynthesis, and the like.

In some instances, a phenotype identified may be a susceptibility to a cancer therapy, including e.g., a MYC-dependent susceptibility to a cancer therapy. A MYC-driven neoplasm having a MYC-dependent susceptibility to a cancer therapy may be more susceptible to the cancer therapy than the corresponding neoplasm that lacks or displays reduced MYC expression (including e.g., where the MYC expression is conditionally controlled). By "cancer therapy", in the instant context, is meant any convenient cancer therapy including but not limited to e.g., radiation therapy, chemotherapy, immunotherapy, and the like.

As noted above, the subject methods of identifying a MYC-dependent target gene will generally include contacting a first cell line and a second cell line with the CRISPR-based gene silencing agent where the first and second cell lines differ in their expression of MYC. The first and second cell lines will generally be sufficiently similar to allow for a meaningful comparison, including e.g., where the first and second cell lines are identical except for their expression of MYC. In some instances, the first and second cell lines may be identical (i.e., derived from the same parental cell line) and may differ in their expression of MYC only by the presence or absence of an agent that induces or represses expression of MYC. For example, in some instances, a cell line useful in the subject methods may be a cell line that conditionally expresses or repress MYC in the presence of tetracycline or an analog thereof. In some instances, the first and second cell lines may only differ in that one has been contacted with an agent that induces or represses MYC expression in the cell line (e.g., tetracycline or an analog thereof) and the other has not been contacted with the agent. In such instances, tetracycline or any analog thereof may be employed.

In some embodiments, useful cell lines may include a Tet-responsive element (e.g., a Tet-repressor or a Tet-activator) or a combination thereof operably linked to a myc locus encoding MYC. Such a myc locus may be an endogenous or a heterologous myc locus expressing an endogenous or a heterologous MYC. Useful cell lines will generally include neoplastic cell lines, including cancer or tumor cell lines, including but are not limited to e.g., those derived from various mammalian cancers including e.g., Acute Lymphoblastic Leukemia (ALL), Acute Myeloid Leukemia (AML), Adrenocortical Carcinoma, AIDS-Related Cancers (e.g., Kaposi Sarcoma, Lymphoma, etc.), Anal Cancer, Appendix Cancer, Astrocytomas, Atypical Teratoid/Rhabdoid Tumor, Basal Cell Carcinoma, Bile Duct Cancer (Extrahepatic), Bladder Cancer, Bone Cancer (e.g., Ewing Sarcoma, Osteosarcoma and Malignant Fibrous Histiocytoma, etc.), Brain Stem Glioma, Brain Tumors (e.g., Astrocytomas, Central Nervous System Embryonal Tumors, Central Nervous System Germ Cell Tumors, Craniopharyngioma, Ependymoma, etc.), Breast Cancer (e.g., female breast cancer, male breast cancer, childhood breast cancer, etc.), Bronchial Tumors, Burkitt Lymphoma, Carcinoid Tumor (e.g., Childhood, Gastrointestinal, etc.), Carcinoma of Unknown Primary, Cardiac (Heart) Tumors, Central Nervous System (e.g., Atypical Teratoid/Rhabdoid Tumor, Embryonal Tumors, Germ Cell Tumor, Lymphoma, etc.), Cervical Cancer, Childhood Cancers, Chordoma, Chronic Lymphocytic Leukemia (CLL), Chronic Myelogenous Leukemia (CML), Chronic Myeloproliferative Neoplasms, Colon Cancer, Colorectal Cancer, Craniopharyngioma, Cutaneous T-Cell Lymphoma, Duct (e.g., Bile Duct, Extrahepatic, etc.), Ductal Carcinoma In Situ (DCIS), Embryonal Tumors, Endometrial Cancer, Ependymoma, Esophageal Cancer, Esthesioneuroblastoma, Ewing Sarcoma, Extracranial Germ Cell Tumor, Extragonadal Germ Cell Tumor, Extrahepatic Bile Duct Cancer, Eye Cancer (e.g., Intraocular Melanoma, Retinoblastoma, etc.), Fibrous Histiocytoma of Bone (e.g., Malignant, Osteosarcoma, ect.), Gallbladder Cancer, Gastric (Stomach) Cancer, Gastrointestinal Carcinoid Tumor, Gastrointestinal Stromal Tumors (GIST), Germ Cell Tumor (e.g., Extracranial, Extragonadal, Ovarian, Testicular, etc.), Gestational Trophoblastic Disease, Glioma, Hairy Cell Leukemia, Head and Neck Cancer, Heart Cancer, Hepatocellular (Liver) Cancer, Histiocytosis (e.g., Langerhans Cell, etc.), Hodgkin Lymphoma, Hypopharyngeal Cancer, Intraocular Melanoma, Islet Cell Tumors (e.g., Pancreatic Neuroendocrine Tumors, etc.), Kaposi Sarcoma, Kidney Cancer (e.g., Renal Cell, Wilms Tumor, Childhood Kidney Tumors, etc.), Langerhans Cell Histiocytosis, Laryngeal Cancer, Leukemia (e.g., Acute Lymphoblastic (ALL), Acute Myeloid (AML), Chronic Lymphocytic (CLL), Chronic Myelogenous (CML), Hairy Cell, etc.), Lip and Oral Cavity Cancer, Liver Cancer (Primary), Lobular Carcinoma In Situ (LCIS), Lung Cancer (e.g., Non-Small Cell, Small Cell, etc.), Lymphoma (e.g., AIDS-Related, Burkitt, Cutaneous T-Cell, Hodgkin, Non-Hodgkin, Primary Central Nervous System (CNS), etc.), Macroglobulinemia (e.g., Waldenström, etc.), Male Breast Cancer, Malignant Fibrous Histiocytoma of Bone and Osteosarcoma, Melanoma, Merkel Cell Carcinoma, Mesothelioma, Metastatic Squamous Neck Cancer with Occult Primary, Midline Tract Carcinoma Involving NUT Gene, Mouth Cancer, Multiple Endocrine Neoplasia Syndromes, Multiple Myeloma/Plasma Cell Neoplasm, Mycosis Fungoides, Myelodysplastic Syndromes, Myelodysplastic/Myeloproliferative Neoplasms, Myelogenous Leukemia (e.g., Chronic (CML), etc.), Myeloid Leukemia (e.g., Acute (AML), etc.), Myeloproliferative Neoplasms (e.g., Chronic, etc.), Nasal Cavity and Paranasal Sinus Cancer, Nasopharyngeal Cancer, Neuroblastoma, Non-Hodgkin Lymphoma, Non-Small Cell Lung Cancer, Oral Cancer, Oral Cavity Cancer (e.g., Lip, etc.), Oropharyngeal Cancer, Osteosarcoma and Malignant Fibrous Histiocytoma of Bone, Ovarian Cancer (e.g., Epithelial, Germ Cell Tumor, Low Malignant Potential Tumor, etc.), Pancreatic Cancer, Pancreatic Neuroendocrine Tumors (Islet Cell Tumors), Papillomatosis, Paraganglioma, Paranasal Sinus and Nasal Cavity Cancer, Parathyroid Cancer, Penile Cancer, Pharyngeal Cancer, Pheochromocytoma, Pituitary Tumor, Pleuropulmonary Blastoma, Primary Central Nervous System (CNS) Lymphoma, Prostate Cancer, Rectal Cancer, Renal Cell (Kidney) Cancer, Renal Pelvis and Ureter, Transitional Cell Cancer, Retinoblastoma, Rhabdomyosarcoma, Salivary Gland Cancer, Sarcoma (e.g., Ewing, Kaposi, Osteosarcoma, Rhabdomyosarcoma, Soft Tissue, Uterine, etc.), Sézary Syndrome, Skin Cancer (e.g., Childhood, Melanoma, Merkel Cell Carcinoma, Nonmelanoma, etc.), Small Cell Lung Cancer, Small Intestine Cancer, Soft Tissue Sarcoma, Squamous Cell Carcinoma, Squamous Neck Cancer (e.g., with Occult Primary, Metastatic, etc.), Stomach (Gastric) Cancer, T-Cell Lymphoma, Testicular Cancer, Throat Cancer, Thymoma and Thymic Carcinoma, Thyroid Cancer, Transitional Cell Cancer of the Renal Pelvis and Ureter, Ureter and Renal Pelvis Cancer, Urethral Cancer, Uterine Cancer (e.g., Endometrial, etc.), Uterine Sarcoma, Vaginal Cancer, Vulvar Cancer, Waldenström Macroglobulinemia, Wilms Tumor, and the like.

In some instances, a tumor cell line of the subject methods may be a carcinoma. Useful carcinoma tumor cell lines include but are not limited to e.g., those derived from a carcinoma including but not limited to e.g., acinar carcinoma, acinic cell carcinoma, acinous carcinoma, adenocystic carcinoma, adenoid cystic carcinoma, adenosquamous carcinoma, adnexal carcinoma, adrenocortical carcinoma, alveolar carcinoma, ameloblastic carcinoma, apocrine carcinoma, basal cell carcinoma, bronchioloalveolar carcinoma, bronchogenic carcinoma, cholangiocellular carcinoma, chorionic carcinoma, clear cell carcinoma, colloid carcinoma, cribriform carcinoma, ductal carcinoma in situ, embryonal carcinoma, carcinoma en cuirasse, endometrioid carcinoma, epidermoid carcinoma, carcinoma ex mixed tumor, carcinoma ex pleomorphic adenoma, follicular carcinoma of thyroid gland, hepatocellular carcinoma, carcinoma in si'tu, intraductal carcinoma, Hürthle cell carcinoma, inflammatory carcinoma of the breast, large cell carcinoma, invasive lobular carcinoma, lobular carcinoma, lobular carcinoma in situ (LCIS), medullary carcinoma, meningeal carcinoma, Merkel cell carcinoma, mucinous carcinoma, mucoepidermoid carcinoma, nasopharyngeal carcinoma, non-small cell carcinoma, non-small cell lung carcinoma (NSCLC), oat cell carcinoma, papillary carcinoma, renal cell carcinoma, scirrhous carcinoma, sebaceous carcinoma, carcinoma sim'plex, signet-ring cell carcinoma, small cell carcinoma, small cell lung carcinoma, spindle cell carcinoma, squamous cell carcinoma, terminal duct carcinoma, transitional cell carcinoma, tubular carcinoma, verrucous carcinoma, and the like.

The subject methods of identifying a MYC-dependent target gene may be performed in multiplex fashion, including e.g., where contacting the cell lines with a CRISPR-based gene silencing agent targeting a target gene may include contacting the cell lines with a plurality of CRISPR-based gene silencing agents targeting a plurality of different target genes. Such pluralities of target genes will vary and may include e.g., where the plurality includes all or essentially all of the genes of a genome of a subject such as a mammal (e.g., a mouse, rat, primate, human, etc.). In some instances, a plurality of target genes may include only the genes of a particular functional group including e.g., genes involved in RNA metabolism. In some instances, a plurality of CRISPR-based gene silencing agents may be referred to as a library of CRISPR-based gene silencing agents and contacting cell lines, as described herein, may include contacting the cell line with the library.

As summarized above, the methods of the present disclosure include treating a subject for a MYC-driven neoplasia by administering to the subject an effective amount (e.g., a therapeutically effective amount) of an agent that inhibits a MYC-dependent target gene or the expression product thereof. Such methods may include administering to a subject one or more agents that inhibit a MYC-dependent target gene identified utilizing the methods of CRISPR/Cas9-based screening described herein. In some instances, the subject methods include administering to a subject an inhibitor of a MYC-dependent target gene identified according to the methods described herein as a MYC-dependent synthetic lethal target gene. Targets employed in the subject methods need not necessarily be limited to those identified in a subject screen and may generally include other targets that when inhibited preferentially treat MYC-driven neoplasia as compared to MYC-independent neoplasia.

In some embodiments, the methods of the present disclosure include treating a subject for a MYC-driven cancer by administering to the subject one or more inhibitors of a MYC-dependent target gene and/or one or more inhibitors of an expression product of a MYC-dependent target gene. In some instances, such MYC-dependent target genes include but are not limited to e.g., those identified as producing a MYC-dependent phenotype in a CRISPR/Cas9-based screen as described herein. Non-limiting examples of MYC-dependent target genes include but are not limited to e.g., Aamp, Aars, Aars2, Abcb7, Aco2, Actg1, Actr10, Adm, Ahr, Akirin2, Aldoa, Alg3, Alg6, Anapc10, Ankrd52, Ap1m1, Api5, Arcn1, Arglu1, Arhgap27, Arl4c, Armc7, Arpc4, Art4, Ascc2, Asf1a, Ash2l, Atad3a, Atf4, Atg14, Atp5a1, Atp5b, Atp5f1, Atp5j2, Atp5k, Atp6v0d1, Atp6v1a, Atp6v1f, Atp8a1, Atp8b3, Atr, Atxn10, B3gnt2, Bap1, Bard1, BC017158, BC052040, Bccip, Bend3, Birc5, Bmpr1a, Bora, Brat1, Brd4, Brd9, Brf2, Bricd5, Brpf1, C1d, Cacnb3, Cad, Caprin2, Ccdc101, Ccdc115, Ccdc130, Ccna2, Ccnc, Ccnd1, Ccnh, Cct8, Cd151, Cdc123, Cdc26, Cdc42, Cdc45, Cdca3, Cdca7l, Cdh1, Cdk2ap2, Cdk9, Cdkl3, Ceacam11, Cebpb, Cenpe, Chaf1b, Chchd4, Chka, Chmp1a, Chordc1, Ciao1, Cinp, Cirh1a, Ckap5, Clcc1, Cmpk1, Cnot10, Cog6, Cog7, Commd1, Commd3, Copg1, Cops2, Cops3, Cox17, Cox7c, Cpsf3, Crep, Crebbp, Cs, Csell, Csprs, Ctbp2, Cwc22, D2Wsu81e, Dars2, Dazap1, Dbr1, Dclre1b, Dcps, Dctn3, Dctn6, Ddb2, Ddi2, Ddost, Ddx1, Ddx10, Ddx17, Ddx21, Ddx31, Ddx39, Ddx51, Ddx52, Ddx55, Ddx59, Decr2, Dgkq, Dhodh, Dhx33, Dhx35, Dhx9, Dip2a, Dis3, Dkc1, Dlgap3, Dmap1, Dnajc11, Dnajc2, Dnm2, Dnpep, Dnttip1, Dohh, Dpagt1, Dph1, Dph2, Dph5, Dph6, Dpm2, Dscc1, Dtx3, Dtymk, Dusp12, Dut, Dynll1, Dynlrb1, Dynlt1a, E2f2, E2f3, Ear11, Ears2, Ebna1bp2, Ect2, Eed, Eef2, Ehmt1, Eif1ad, Eif2s3x, Eif3j1, Elof1, Elp4, Emc1, Enol, Ep300, Ercc2, Ercc3, Erdr1, Erh, Esf1, Exoc3, Exoc8, Exosc2, Exosc7, Eya2, F8a, Fam210a, Fam83d, Fam96a, Fam96b, Fam98b, Fance, Farsb, Fbxo11, Fbxo5, Fdx11, Fdxr, Fermt2, Fgf5, Fkbp2, Fkbp4, Fosl1, Fpgs, Frg1, Ftsj3, Fus, Fut1, Fxn, G3bp1, Gabrq, Gadd45g, Gapdh, Gar1, Gatad2a, Gatc, Gclc, Gfer, Gfm1, Gigyf1, Gins1, Gins3, Gins4, Glul, Gmnn, Gmppb, Gpatch1, Gpkow, Gpn3, Gpr111, Gpr137b, Gps1, Gps2, Grpel1, Gsn, Gtf2b, Gtf2f2, Gtf2h3, Gtf3c4, Gtf3c5, Gtpbp4, H2afz, Hars, Haus1, Hbb-bh1, Hccs, Hdac2, Heatr3, Hectd2, Hes6, Hiat1, Hinfp, Hira, Hist1h1d, Hist1h2ac, Hist1h2ae, Hist1h2ag, Hist1h2ai, Hist1h2ao, Hist1h2ap, Hist1h2bc, Hist1h2be, Hist1h2bg, Hist1h2bh, Hist1h2bl, Hist1h2bm, Hist1h2bq, Hist1h2br, Hist1h3a, Hist1h3c, Hist1h3i, Hist1h4a, Hist1h4j, Hist1h4k, Hist1h4m, Hist1h4n, Hist2h2be, Hmgcs1, Hmmr, Hnf1a, Hnrnpa1, Hnrnpf, Hnrnpl, Hnrnpu, Hpcal1, Hscb, Hsd17b10, Hsp90ab1, Hspe1, Hus1, Huwe1, Hyou1, Hypk, Iars2, Ibsp, Idh3a, Idi1, Ikbkap, Ilf2, Imp3, Imp4, Inpp5a, Ints4, Kansl2, Kars, Katnb1, Kcng3, Kctd7, Kdm2a, Keap1, Kif18b, Kif20a, Kif23, Kif2c, Kmt2a, Kntc1, Krr1, Krt9, Krtap4-13, Krtap5-5, Kti12, Lamtor1, Lamtor2, Lamtor5, Lars2, Lbh, Lce3c, Lemd2, Lin37, Lin52, Lipe, Lrch3, Lrrc10b, Lrrc59, Lsm10, Lsm11, Lsm14, Lsm5, Lsm7, Ltbp3, Luc7l3, Lyrm4, Maea, Map1lc3a, Mapk1, Mars2, Mbtd1, Mbtps1, Mbtps2, Mcm10, Mcm3, Mcm5, Mcm6, Mcmbp, Mctp1, Mdn1, Med10, Med12, Med13, Med18, Med21, Med23, Med26, Med8, Mesdc2, Metap1, Mettl14, Mettl16, Mettl22, Mfap3, Mfn1, Mfsd10, Mfsd7b, Minos1, Mis12, Mlxip, Mmadhc, Mmp28, Mms19, Mnt, Mob1b, Mob3c, Mpdu1, Mplkip, Mpped2, Mprip, Mre11a, Mrp63, Mrpl12, Mrpl13, Mrpl20, Mrpl21, Mrpl23, Mrpl36, Mrpl39, Mrpl4, Mrpl41, Mrpl49, Mrpl51, Mrpl52, Mrps18a, Mrps18b, Mrps21, Mrps31, Msl1, Msn, Mta2, Mtch2, Mtor, Mtx2, Mup14, Mvd, Mybbp1a, Mybl2, N6amt1, Naa50, Naca, Nacc2, Nars2, Ncapd2, Ncaph2, Ndc80, Ndnl2, Ndufb4, Ndufv1, Nek8, Nelfb, Nelfcd, Nexn, Ngdn, Nhlrc2, Nipbl, Nme3, Nob1, Noc3l, Nol6, Nol9, Nop10, Nop16, Nop56, Nprl3, Nsa2, Nsmce2, Nsmce4a, Ntng2, Nudt5, Nufip2, Numa1, Nup153, Nup93, Nus1, Odf1, Olfr131, Olfr1355, Olfr1414, Olfr181, Olfr523, Olfr77, Olfr818, Olfr98, Onecut2, Orc3, Orc4, Orc5, Osbpl7, Osbpl8, Otud5, P2rx3, Paf1, Pak1ip1, Pak2, Pcnt, Pcnxl3, Pdap1, Pdcd10, Pdcd11, Pdcd7, Pdcl, Pdhb, Pes1, Pfas, Pfdn1, Pfdn4, Pfdn5, Pgam1, Pgap2, Pgd, Pgp, Pgs1, Phf6, Phip, Pi4ka, Pi4kb, Piga, Pigm, Pik3r4, Pla2g7, Plk4, Plxnb3, Pmpcb, Pno1, Pnpt1, Pold1, Pold2, Pold3, Polr1b, Polr1c, Polr1e, Polr2g, Polr2j, Polr2l, Polr3k, Ppara, Ppil4, Ppp1r15b, Ppp1r16b, Ppp2r1a, Ppp2r2d, Ppp2r4, Ppp4c, Ppp4r1, Ppwd1, Pramel7, Prkcb, Prkcsh, Prkrir, Prmt1, Prmt5, Prpf8, Prr19, Prr3, Psmb1, Psmb4, Psmb6, Psmb7, Ptcd3, Ptma, Ptpmt1, Ptpn1, Pvrl2, Pxmp2, Pyroxd1, Qrsl1, Rab35, Rab6a, Rab7, Rabl6, Rad21, Rad51, Rad9a, Ranbp3, Rars, Rbbp4, Rbm8a, Rce1, Recql4, Rfc2, Rfc4, Rfc5, Rfpl4b, Rhox2f, Ric8, Rnf138rt1, Rngtt, Romo1, Rpa2, Rpa3, Rpl13a, Rpl14, Rpl26, Rpl3, Rpl31, Rpl32, Rpl35a, Rpl36al, Rpl37a, Rpl39, Rpl5, Rpl7, Rplp1, Rps10, Rps12, Rps15a, Rps19, Rps21, Rps25, Rps28, Rps3a1, Rps6, Rps8, Rpsa, Rptor, Rrm1, Rrp12, Rrp15, Rsrc2, Rtfdc1, S100a2, S1pr4, Sae1, Safb2, Sall2, Samm50, Sbds, Sbno1, Scd2, Sdad1, Sdhd, Sec22b, Sel11, Sema4f, Sema7a, Sf3a1, Sf3a2, Sf3a3, Sf3b5, Sh3bgr, Shq1, Sirt6, Sirt7, Slc22a30, Slc25a26, Slc25a3, Slc25a41, Slc35a2, Slc35b1, Slc35b2, Slc3a2, Slc7a6os, Slk, Smarcd1, Smc1a, Smc2, Smg7, Smndc1, Snapin, Snf8, Snrnp35, Snrpa1, Snrpd2, Snrpf, Snx15, Sod1, Son, Sp3, Spata5l1, Spcs1, Spint4, Sprr2d, Srek1, Srp14, Srp72, Srp9, Srsf3, Srsf7, Ss18, Ssb, Stag2, Stub1, Stxbp3a, Sumo2, Supt16, Sympk, Syt14, Syvn1, Tada1, Tada3, Taf1, Taf10, Taf11, Taf13, Taf1c, Taf2, Taf3, Taf6l, Taf7, Tapt1, Tardbp, Tbcb, Tbp, Tdrd12, Telo2, Tenm2, Tfap4, Tfb2m, Tgif1, Timm10, Timm17b, Timm23, Tinf2, Tlk2, Tlx3, Tma16, Tmem165, Tmem199, Tmem200b, Tmem223, Tmem41b, Tmx1, Tmx2, Tnpo1, Tnpo3, Toe1, Tom1l2, Tomm22, Tomm40, Top3a, Tor1aip1, Tpi1, Tpm2, Tra2b, Traip, Trappc3, Trim2, Trim66, Trmt112, Trmt5, Trmt6, Trmt61a, Tsen15, Tsr2, Tssc1, Tssc4, Ttc1, Ttc23, Ttc27, Ttc4, Ttf1, Ttf2, Tti2, Ttl, Ttll4, Tubb4a, Tubb5, Tufm, Tut1, Txn1, Txndc15, Tyms, U2af2, Uba2, Uba3, Uba5, Ubap2l, Ube2l3, Ube2m, Ubr4, Ubtf, Uhrf1, Uqcc2, Uqcrb, Urb1, Uri1, Urod, Uso1, Usp37, Usp5, Usp7, Utp18, Utp23, Uxt, Vac14, Vbp1, Vcp, Vdac1, Vimp, Vmn1r101, Vmn1r116, Vmn1r117, Vmn1r119, Vmn1r129, Vmn1r135, Vmn1r157, Vmn1r165, Vmn1r175, Vmn1r210, Vmn1r50, Vmn1r94, Vmn2r35, Vmn2r49, Vmp1, Vps11, Vps18, Vps25, Vps29, Vps33a, Vps39, Vps45, Vps54, Vwa9, Wars, Wars2, Wdhd1, Wdr16, Wdr43, Wdr46, Wdr5, Wdr55, Wdr73, Wdr75, Wdr77, Wdr82, Wnk1, Xrcc3, Xrn2, Yae1d1, Yap1, Zbed4, Zbtb22, Zbtb7a, Zc3h18, Zdhhc18, Zfhx3, Zfp207, Zfp532, Zfp687, Zfp750, Zfr, Znhit2, Znhit3, Znhit6, Znrd1, Zscan4d, Zwilch and Zzz3.

In some embodiments, the methods of the present disclosure include treating a subject for a MYC-driven cancer by administering the subject an effective amount of one or more inhibitors of a MYC-dependent target gene and/or one or more inhibitors of an expression product of a MYC-dependent target gene selected from: AARS, AARS2, ACO2, ADM, AHR, ALDOA, ARPC4, ATP5A1, ATP5B, ATP6V1A, ATP8A1, ATR, AURKA, BIRC5, BRD4, CACNB3, CAD, CCNA2, CCND1, CDCA3, CDK9, CMPK1, COX7C, CREBBP, CS, DARS2, DCPS, DHODH, DNPEP, DTYMK, EARS2, EEF2, EHMT1, EP300, ERCC2, FARSB, FDXR, FPGS, GABRQ, GAPDH, GCLC, GLUL, GSN, HARS, HDAC2, HMGCS1, HSP90AB1, IARS2, KARS, KDM2A, KEAP1, KIF2C, LARS2, MAPK1, METAP1, MMP28, MTOR, NARS2, P2RX3, PDHB, PFAS, PGD, PGP, PI4KA, PI4KB, PIK3R4, PIM3, PLA2G7, PPARA, PPP2R1A, PRKCB, PRMT5, PSMB1, PSMB4, PSMB6, PSMB7, PTMA, PTPN1, RAD51, RPL13A, RPL3, RPTOR, RRM1, S100A2, S1PR4, SDHD, SIRT6, SIRT7, SLK, SOD1, TOMM40, TPI1, TRAPPC3, TUBB5, TYMS, UBA3, UQCRB, UROD, USP5, VCP, VDAC1, WARS, WARS2 and XRCC3.

Representative gene and protein database identifiers and amino acid sequences of the subject MYC-dependent target genes listed above include: AARS (Entrez GeneID 16; UniprotID P49588; SEQ ID NO:3), AARS2 (Entrez GeneID 57505; UniprotID Q5JTZ9; SEQ ID NO:4), ACO2 (Entrez GeneID 50; UniprotID Q99798; SEQ ID NO:5), ADM (Entrez GeneID 133; UniprotID P35318; SEQ ID NO:6), AHR (Entrez GeneID 196; UniprotID P35869; SEQ ID NO:7), ALDOA (Entrez GeneID 226; UniprotID P04075; SEQ ID NO:8), ARPC4 (Entrez GeneID 10093; UniprotID P59998; SEQ ID NO:9), ATP5A1 (Entrez GeneID 498; UniprotID P25705; SEQ ID NO:10), ATP5B (Entrez GeneID 506; UniprotID P06576; SEQ ID NO:11), ATP6V1A (Entrez GeneID 523; UniprotID P38606; SEQ ID NO:12), ATP8A1 (Entrez GeneID 10396; UniprotID Q9Y2Q0; SEQ ID NO:13), ATR (Entrez GeneID 545; UniprotID Q13535; SEQ ID NO:14), AURKA (Entrez GeneID 6790; UniprotID O14965; SEQ ID NO:15), BIRC5 (Entrez GeneID 332; UniprotID O15392; SEQ ID NO:16), BRD4 (Entrez GeneID 23476; UniprotID O60885; SEQ ID NO:17), CACNB3 (Entrez GeneID 784; UniprotID P54284; SEQ ID NO:18), CAD (Entrez GeneID 790; UniprotID P27708; SEQ ID NO:19), CCNA2 (Entrez GeneID 890; UniprotID P20248; SEQ ID NO:20), CCND1 (Entrez GeneID 595; UniprotID P24385; SEQ ID NO:21), CDCA3 (Entrez GeneID 83461; UniprotID Q99618; SEQ ID NO:22), CDK9 (Entrez GeneID 1025; UniprotID P50750; SEQ ID NO:23), CMPK1 (Entrez GeneID 51727; UniprotID P30085; SEQ ID NO:24), COX7C (Entrez GeneID 1350; UniprotID P15954; SEQ ID NO:25), CREBBP (Entrez GeneID 1387; UniprotID Q92793; SEQ ID NO:26), CS (Entrez GeneID 1431; UniprotID O75390; SEQ ID NO:27), DARS2 (Entrez GeneID 55157; UniprotID Q6P148; SEQ ID NO:28), DCPS (Entrez GeneID 28960; UniprotID Q96C86; SEQ ID NO:29), DHODH (Entrez GeneID 1723; UniprotID Q02127; SEQ ID NO:30), DNPEP (Entrez GeneID 23549; UniprotID Q9ULA0; SEQ ID NO:31), DTYMK (Entrez GeneID 1841; UniprotID P23919; SEQ ID NO:32), EARS2 (Entrez GeneID 124454; UniprotID Q5JPH6; SEQ ID NO:33), EEF2 (Entrez GeneID 1938; UniprotID P13639; SEQ ID NO:34), EHMT1 (Entrez GeneID 79813; UniprotID Q9H9B1; SEQ ID NO:35), EP300 (Entrez GeneID 2033; UniprotID Q09472; SEQ ID NO:36), ERCC2 (Entrez GeneID 2068; UniprotID P18074; SEQ ID NO:37), FARSB (Entrez GeneID 10056; UniprotID Q9NSD9; SEQ ID NO:38), FDXR (Entrez GeneID 2232; UniprotID P22570; SEQ ID NO:39), FPGS (Entrez GeneID 2356; UniprotID Q05932; SEQ ID NO:40), GABRQ (Entrez GeneID 55879; UniprotID Q9UN88; SEQ ID NO:41), GAPDH (Entrez GeneID 2597; UniprotID P04406; SEQ ID NO:42), GCLC (Entrez GeneID 2729; UniprotID P48506; SEQ ID NO:43), GLUL (Entrez GeneID 2752; UniprotID P15104; SEQ ID NO:44), GSN (Entrez GeneID 2934; UniprotID P06396; SEQ ID NO:45), HARS (Entrez GeneID 3035; UniprotID P12081; SEQ ID NO:46), HDAC2 (Entrez GeneID 3066; UniprotID Q92769; SEQ ID NO:47), HMGCS1 (Entrez GeneID 3157; UniprotID Q01581; SEQ ID NO:48), HSP90AB1 (Entrez GeneID 3326; UniprotID P08238; SEQ ID NO:49), IARS2 (Entrez GeneID 55699; UniprotID Q9NSE4; SEQ ID NO:50), KARS (Entrez GeneID 3735; UniprotID Q15046; SEQ ID NO:51), KDM2A (Entrez GeneID 22992; UniprotID Q9Y2K7; SEQ ID NO:52), KEAP1 (Entrez GeneID 9817; UniprotID Q14145; SEQ ID NO:53), KIF2C (Entrez GeneID 11004; UniprotID Q99661; SEQ ID NO:54), LARS2 (Entrez GeneID 23395; UniprotID Q15031; SEQ ID NO:55), MAPK1 (Entrez GeneID 5594; UniprotID P28482; SEQ ID NO:56), METAP1 (Entrez GeneID 23173; UniprotID P53582; SEQ ID NO:57), MMP28 (Entrez GeneID 79148; UniprotID Q9H239; SEQ ID NO:58), MTOR (Entrez GeneID 2475; UniprotID P42345; SEQ ID NO:59), NARS2 (Entrez GeneID 79731; UniprotID Q96I59; SEQ ID NO:60), P2RX3 (Entrez GeneID 5024; UniprotID P56373; SEQ ID NO:61), PDHB (Entrez GeneID 5162; UniprotID P11177; SEQ ID NO:62), PFAS (Entrez GeneID 5198; UniprotID O15067; SEQ ID NO:63), PGD (Entrez GeneID 5226; UniprotID P52209; SEQ ID NO:64), PGP (Entrez GeneID 283871; UniprotID A6NDG6; SEQ ID NO:65), PI4KA (Entrez GeneID 5297; UniprotID P42356; SEQ ID NO:66), PI4KB (Entrez GeneID 5298; UniprotID Q9UBF8; SEQ ID NO:67), PIK3R4 (Entrez GeneID 30849; UniprotID Q99570; SEQ ID NO:68), PIM3 (Entrez GeneID 415116; UniprotID Q86V86; SEQ ID NO:69), PLA2G7 (Entrez GeneID 7941; UniprotID Q13093; SEQ ID NO:70), PPARA (Entrez GeneID 5465; UniprotID Q07869; SEQ ID NO:71), PPP2R1A (Entrez GeneID 5518; UniprotID P30153; SEQ ID NO:72), PRKCB (Entrez GeneID 5579; UniprotID P05771; SEQ ID NO:73), PRMT5 (Entrez GeneID 10419; UniprotID O14744; SEQ ID NO:74), PSMB1 (Entrez GeneID 5689; UniprotID P20618; SEQ ID NO:75), PSMB4 (Entrez GeneID 5692; UniprotID P28070; SEQ ID NO:76), PSMB6 (Entrez GeneID 5694; UniprotID P28072; SEQ ID NO:77), PSMB7 (Entrez GeneID 5695; UniprotID Q99436; SEQ ID NO:78), PTMA (Entrez GeneID 5757; UniprotID P06454; SEQ ID NO:79), PTPN1 (Entrez GeneID 5770; UniprotID P18031; SEQ ID NO:80), RAD51 (Entrez GeneID 5888; UniprotID Q06609; SEQ ID NO:81), RPL13A (Entrez GeneID 23521; UniprotID P40429; SEQ ID NO:82), RPL3 (Entrez GeneID 6122; UniprotID P39023; SEQ ID NO:83), RPTOR (Entrez GeneID 57521; UniprotID Q8N122; SEQ ID NO:84), RRM1 (Entrez GeneID 6240; UniprotID P23921; SEQ ID NO:85), S100A2 (Entrez GeneID 6273; UniprotID P29034; SEQ ID NO:86), S1PR4 (Entrez GeneID 8698; UniprotID O95977; SEQ ID NO:87), SDHD (Entrez GeneID 6392; UniprotID O14521; SEQ ID NO:88), SIRT6 (Entrez GeneID 51548; UniprotID Q8N6T7; SEQ ID NO:89), SIRT7 (Entrez GeneID 51547; UniprotID Q9NRC8; SEQ ID NO:90), SLK (Entrez GeneID 9748; UniprotID Q9H2G2; SEQ ID NO:91), SOD1 (Entrez GeneID 6647; UniprotID P00441; SEQ ID NO:92), TOMM40 (Entrez GeneID 10452; UniprotID O96008; SEQ ID NO:93), TPI1 (Entrez GeneID 7167; UniprotID P60174; SEQ ID NO:94), TRAPPC3 (Entrez GeneID 27095; UniprotID O43617; SEQ ID NO:95), TUBB5 (Entrez GeneID 10382; UniprotID P04350; SEQ ID NO:96), TYMS (Entrez GeneID 7298; UniprotID P04818; SEQ ID NO:97), UBA3 (Entrez GeneID 9039; UniprotID Q8TBC4; SEQ ID NO:98), UQCRB (Entrez GeneID 7381; UniprotID P14927; SEQ ID NO:99), UROD (Entrez GeneID 7389; UniprotID P06132; SEQ ID NO:100), USP5 (Entrez GeneID 8078; UniprotID P45974; SEQ ID NO:101), VCP (Entrez GeneID 7415; UniprotID P55072; SEQ ID NO:102), VDAC1 (Entrez GeneID 7416; UniprotID P21796; SEQ ID NO:103), WARS (Entrez GeneID 7453; UniprotID P23381; SEQ ID NO:104), WARS2 (Entrez GeneID 10352; UniprotID Q9UGM6; SEQ ID NO:105) and XRCC3 (Entrez GeneID 7517; UniprotID O43542; SEQ ID NO:106).

In some embodiments, the methods of the present disclosure include treating a subject for a MYC-driven cancer by administering to the subject an effective amount of one or more inhibitors of a MYC-dependent target gene and/or one or more inhibitors of an expression product of a MYC-dependent target gene selected from: AHR, AURKA, BIRC5, BRD4, CDK9, EP300, HMGCS1, MTOR, PIM3 and PRMT5.

In some embodiments, the methods of the present disclosure include treating a subject for a MYC-driven cancer by administering to the subject an effective amount of one or more inhibitors of a protein involved in RNA metabolism, including but not limited to e.g., RNA transcription amplification, mRNA splicing, ribosomal biogenesis, RNA transport or RNA degradation.

In some embodiments, the methods of the present disclosure include treating a subject for a MYC-driven cancer by administering to the subject an effective amount of one or more inhibitors of ribosome formation or activity including e.g., an inhibitor of RPS12, RPL37A, MRPL21, MRPL20, MRPL23, RPL7, RPLP1, RPL5, RPL35A, RPS15A, RPS6, RPS10, MRPL13, RPL36AL, MRPS21, RPS8, RPL26, RPL13A, RPS19, MRPL36, MRPL12, RPS25, RPS21, MRPS18A, RPS28, RPL3, RPL14, MRPL4, RPSA, RPL39, RPL32 or RPL31.

In some embodiments, the methods of the present disclosure include treating a subject for a MYC-driven cancer by administering to the subject an effective amount of one or more inhibitors of RNA transport including e.g., an inhibitor of SMN1, NCBP1, SEH1L, EEF1A1, SUMO2, UPF1, NDC1, EIF5B, XPO1, RBM8A, EIF3A, EIF3B, EIF3F, NUP43, PABPC1, NUP133, RPP21, NUP160, ACIN1, NUP93, ALYREF, PRMT5, RPP25L, THOC1, GEMIN8, GEMIN2, GEMIN7, NUP153, WIBG, POP1, POP7, POP5, POP4 or TRNT1.

In some embodiments, the methods of the present disclosure include treating a subject for a MYC-driven cancer by administering to the subject an effective amount of one or more inhibitors of a basal transcription factor including e.g., an inhibitor of TAF7, TAF13, TAF3, TAF2, TAF6L, GTF2F2, GTF2H3, TBP, ERCC2, ERCC3, GTF2B, TAF1, TAF11, TAF10 or CCNH.

In some embodiments, the methods of the present disclosure include treating a subject for a MYC-driven cancer by administering to the subject an effective amount of one or more inhibitors of aminoacyl-tRNA biosynthesis including e.g., an inhibitor of QRSL1, KARS, IARS2, EARS2, NARS2, AARS, WARS2, WARS, MARS2, FARSB, RARS, DARS2, AARS2, LARS2, HARS or GATC.

In some embodiments, the methods of the present disclosure include treating a subject for a MYC-driven cancer by administering to the subject an effective amount of one or more inhibitors of pyrimidine metabolism including e.g., an inhibitor of POLR1E, POLD1, ZNRD1, NME3, CMPK1, PNPT1, POLD2, TYMS, POLR1B, POLR1C, DTYMK, DHODH, RRM1, POLR2G, POLR2L, POLD3, POLR2J, DUT, POLR3K or CAD.

In some embodiments, the methods of the present disclosure include treating a subject for a MYC-driven cancer by administering to the subject an effective amount of one or more inhibitors of the cell cycle including e.g., an inhibitor of HDAC2, ATR, CCNA2, ANAPC10, GADD45G, SMC1A, RAD21, STAG2, ORC4, ORC5, ORC3, MCM6, MCM5, MCM3, EP300, E2F3, E2F2, CCND1, CDC26, CDC45, CCNH or CREBBP.

In some embodiments, the methods of the present disclosure include treating a subject for a MYC-driven cancer by administering to the subject an effective amount of one or more inhibitors of nucleotide excision repair including e.g., an inhibitor of GTF2H3, RFC4, ERCC2, ERCC3, RFC5, RFC2, POLD1, POLD2, POLD3, RPA3, DDB2, RPA2 or CCNH.

In some embodiments, the methods of the present disclosure include treating a subject for a MYC-driven cancer by administering to the subject an effective amount of one or more inhibitors of spliceosome activity or formation including e.g., an inhibitor of NCBP1, SF3B5, SNRPA1, PRPF8, SRSF7, RBM8A, SRSF3, U2AF2, HNRNPU, SF3A1, SF3A2, SF3A3, TRA2B, LSM7, SMNDC1, LSM5, HNRNPA1, ALYREF, THOC1, SNRPF, SNRPD2 or ACIN1.

In some embodiments, the methods of the present disclosure include treating a subject for a MYC-driven cancer by administering to the subject an effective amount of one or more inhibitors of DNA replication including e.g., an inhibitor of MCM6, RFC5, RFC4, MCM5, RPA3, RFC2, POLD1, POLD2, POLD3, MCM3 or RPA2.

In some embodiments, the methods of the present disclosure include treating a subject for a MYC-driven cancer by administering to the subject an effective amount of one or more inhibitors of homologous recombination including e.g., an inhibitor of MRE11A, RPA3, RPA2, POLD1, POLD2, POLD3, RAD51, XRCC3 or TOP3A.

In some embodiments, the methods of the present disclosure include treating a subject for a MYC-driven cancer by administering to the subject an effective amount of one or more inhibitors of mismatch repair, including e.g., an inhibitor of RFC5, RFC4, RPA3, RFC2, POLD1, POLD2, POLD3 or RPA2.

In some embodiments, the methods of the present disclosure include treating a subject for a MYC-driven cancer by administering to the subject an effective amount of one or more inhibitors of the mRNA surveillance pathway, including e.g., an inhibitor of PPP2R1A, SMG7, SYMPK, NCBP1, DAZAP1, PPP2R2D, ACIN1, ALYREF, WIBG, UPF1, WDR82, PABPC1, RNGTT, CPSF3 or RBM8A.

In some embodiments, the methods of the present disclosure include treating a subject for a MYC-driven cancer by administering to the subject an effective amount of one or more inhibitors of RNA degradation, including e.g., an inhibitor of DCPS, LSM7, PABPC1, PNPT1, CNOT10, C1D, ENO1, DIS3, XRN2, LSM5, EXOSC2 or EXOSC7.

In some embodiments, the methods of the present disclosure include treating a subject for a MYC-driven cancer by administering to the subject an effective amount of one or more inhibitors of terpenoid backbone biosynthesis, including e.g., an inhibitor of MVD, HMGCS1, RCE1, IDI1 or NUS1.

In some instances, the methods of the present disclosure include treating a subject for a MYC-driven cancer by administering to the subject an effective amount of one or more inhibitors of a protein involved in RNA transport including but not limited to e.g., Acin1, Alyref, Eif3a/b/f, Eif5b, Ncbp1, Ndc1, Nups, Pabpc1, Rbm8a, Seh1l, Sumo2, Thoc1, Upf1, Wibg, Xpo1, Gemin2/7/8, Ncbp1, Ndc1, Nups, Prmt5, Seh1l, Smn1, Xpo1, Ndc1, Nups, Pop1/4/5/7, Rpp25l, Seh1l, Xpo1, Eef1a1, Ndc1, Nups, Rpp21, Seh1l and Trnt1. In some instances, the inhibitor of RNA transport inhibits one or more of mRNA transport, snRNA transport, rRNA transport and/or tRNA transport.

In some instances, the methods of the present disclosure include treating a subject for a MYC-driven cancer by administering the subject an effective amount of one or more inhibitors of a protein involved in DNA repair, pyrimidine metabolism, or terpenoid backbone biosynthesis.

Any useful inhibitor of the subject target gene and/or encoded product thereof may be employed in the subject methods. Non-limiting examples of useful inhibitors include but are not limited to e.g., non-peptide small molecule antagonists, peptide antagonists, interfering RNAs (e.g., siRNA, shRNA, etc.), antibodies (e.g., neutralizing antibodies, function blocking antibodies, etc.), aptamers, and the like. In some instances, inhibitors may target, e.g., specifically bind to, specifically hybridize to, etc., a target protein or a nucleic acid encoding a target protein including where the protein shares 100% sequence identity or less than 100% sequence identity, including e.g., at least 99%, at least 98%, at least 97% at least 96%, at least 95%, at least 90%, at least 85%, at least 80%, etc., sequence identity, with a protein or amino acid sequence of a protein described herein. Accordingly, as non-limiting examples, in some instances, useful inhibitors may include a non-peptide small molecule antagonist of a protein involved in RNA metabolism, a peptide antagonist of a protein involved in RNA metabolism, an interfering RNA targeting an RNA expressed from a RNA metabolism gene, an anti-RNA-metabolism-protein antibody (e.g., an antibody that specifically binds to an RNA metabolism protein), an anti-RNA-metabolism-protein aptamer, and the like. In some instances, the effectiveness of an inhibitor may be confirmed using an in vitro or in vivo assay, including e.g., where the effectiveness of the inhibitor is compared to an appropriate control or standard, e.g., the corresponding CRISPR-based gene silencing agent, a conventional cancer therapy, etc.

An individual to be treated according to the present methods will generally be an individual with a neoplasia. As used herein "neoplasia" includes any form of abnormal new tissue formation; and the like. In some cases, the individual has recently undergone treatment for neoplasia (e.g., cancer, a tumor, etc.) and are therefore at risk for recurrence. In some instances, the individual has not recently or previously undergone treatment for a neoplasia (e.g., cancer, a tumor, etc.) but has been newly diagnosed with a neoplasia. Any and all neoplasia are suitable neoplasia to be treated by the subject methods e.g., utilizing a subject inhibitor of a MYC-dependent target gene or a herein described treatment kit. The subject methods will generally include the treatment of MYC-driven neoplasia, including e.g., malignant MYC-driven neoplasia including a MYC-driven cancer, a MYC driven tumor, and the like.

Cancers that may be targeted in the subject methods of treatment include e.g., MYC-driven forms of the following: Acute Lymphoblastic Leukemia (ALL), Acute Myeloid Leukemia (AML), Adrenocortical Carcinoma, AIDS-Related Cancers (e.g., Kaposi Sarcoma, Lymphoma, etc.), Anal Cancer, Appendix Cancer, Astrocytomas, Atypical Teratoid/Rhabdoid Tumor, Basal Cell Carcinoma, Bile Duct Cancer (Extrahepatic), Bladder Cancer, Bone Cancer (e.g., Ewing Sarcoma, Osteosarcoma and Malignant Fibrous Histiocytoma, etc.), Brain Stem Glioma, Brain Tumors (e.g., Astrocytomas, Central Nervous System Embryonal Tumors, Central Nervous System Germ Cell Tumors, Craniopharyngioma, Ependymoma, etc.), Breast Cancer (e.g., female breast cancer, male breast cancer, childhood breast cancer, etc.), Bronchial Tumors, Burkitt Lymphoma, Carcinoid Tumor (e.g., Childhood, Gastrointestinal, etc.), Carcinoma of Unknown Primary, Cardiac (Heart) Tumors, Central Nervous System (e.g., Atypical Teratoid/Rhabdoid Tumor, Embryonal Tumors, Germ Cell Tumor, Lymphoma, etc.), Cervical Cancer, Childhood Cancers, Chordoma, Chronic Lymphocytic Leukemia (CLL), Chronic Myelogenous Leukemia (CML), Chronic Myeloproliferative Neoplasms, Colon Cancer, Colorectal Cancer, Craniopharyngioma, Cutaneous T-Cell Lymphoma, Duct (e.g., Bile Duct, Extrahepatic, etc.), Ductal Carcinoma In Situ (DCIS), Embryonal Tumors, Endometrial Cancer, Ependymoma, Esophageal Cancer, Esthesioneuroblastoma, Ewing Sarcoma, Extracranial Germ Cell Tumor, Extragonadal Germ Cell Tumor, Extrahepatic Bile Duct Cancer, Eye Cancer (e.g., Intraocular Melanoma, Retinoblastoma, etc.), Fibrous Histiocytoma of Bone (e.g., Malignant, Osteosarcoma, ect.), Gallbladder Cancer, Gastric (Stomach) Cancer, Gastrointestinal Carcinoid Tumor, Gastrointestinal Stromal Tumors (GIST), Germ Cell Tumor (e.g., Extracranial, Extragonadal, Ovarian, Testicular, etc.), Gestational Trophoblastic Disease, Glioma, Hairy Cell Leukemia, Head and Neck Cancer, Heart Cancer, Hepatocellular (Liver) Cancer, Histiocytosis (e.g., Langerhans Cell, etc.), Hodgkin Lymphoma, Hypopharyngeal Cancer, Intraocular Melanoma, Islet Cell Tumors (e.g., Pancreatic Neuroendocrine Tumors, etc.), Kaposi Sarcoma, Kidney Cancer (e.g., Renal Cell, Wilms Tumor, Childhood Kidney Tumors, etc.), Langerhans Cell Histiocytosis, Laryngeal Cancer, Leukemia (e.g., Acute Lymphoblastic (ALL), Acute Myeloid (AML), Chronic Lymphocytic (CLL), Chronic Myelogenous (CML), Hairy Cell, etc.), Lip and Oral Cavity Cancer, Liver Cancer (Primary), Lobular Carcinoma In Situ (LCIS), Lung Cancer (e.g., Non-Small Cell, Small Cell, etc.), Lymphoma (e.g., AIDS-Related, Burkitt, Cutaneous T-Cell, Hodgkin, Non-Hodgkin, Primary Central Nervous System (CNS), etc.), Macroglobulinemia (e.g., Waldenström, etc.), Male Breast Cancer, Malignant Fibrous Histiocytoma of Bone and Osteosarcoma, Melanoma, Merkel Cell Carcinoma, Mesothelioma, Metastatic Squamous Neck Cancer with Occult Primary, Midline Tract Carcinoma Involving NUT Gene, Mouth Cancer, Multiple Endocrine Neoplasia Syndromes, Multiple Myeloma/Plasma Cell Neoplasm, Mycosis Fungoides, Myelodysplastic Syndromes, Myelodysplastic/Myeloproliferative Neoplasms, Myelogenous Leukemia (e.g., Chronic (CML), etc.), Myeloid Leukemia (e.g., Acute (AML), etc.), Myeloproliferative Neoplasms (e.g., Chronic, etc.), Nasal Cavity and Paranasal Sinus Cancer, Nasopharyngeal Cancer, Neuroblastoma, Non-Hodgkin Lymphoma, Non-Small Cell Lung Cancer, Oral Cancer, Oral Cavity Cancer (e.g., Lip, etc.), Oropharyngeal Cancer, Osteosarcoma and Malignant Fibrous Histiocytoma of Bone, Ovarian Cancer (e.g., Epithelial, Germ Cell Tumor, Low Malignant Potential Tumor, etc.), Pancreatic Cancer, Pancreatic Neuroendocrine Tumors (Islet Cell Tumors), Papillomatosis, Paraganglioma, Paranasal Sinus and Nasal Cavity Cancer, Parathyroid Cancer, Penile Cancer, Pharyngeal Cancer, Pheochromocytoma, Pituitary Tumor, Pleuropulmonary Blastoma, Primary Central Nervous System (CNS) Lymphoma, Prostate Cancer, Rectal Cancer, Renal Cell (Kidney) Cancer, Renal Pelvis and Ureter, Transitional Cell Cancer, Retinoblastoma, Rhabdomyosarcoma, Salivary Gland Cancer, Sarcoma (e.g., Ewing, Kaposi, Osteosarcoma, Rhabdomyosarcoma, Soft Tissue, Uterine, etc.), Sézary Syndrome, Skin Cancer (e.g., Childhood, Melanoma, Merkel Cell Carcinoma, Nonmelanoma, etc.), Small Cell Lung Cancer, Small Intestine Cancer, Soft Tissue Sarcoma, Squamous Cell Carcinoma, Squamous Neck Cancer (e.g., with Occult Primary, Metastatic, etc.), Stomach (Gastric) Cancer, T-Cell Lymphoma, Testicular Cancer, Throat Cancer, Thymoma and Thymic Carcinoma, Thyroid Cancer, Transitional Cell Cancer of the Renal Pelvis and Ureter, Ureter and Renal Pelvis Cancer, Urethral Cancer, Uterine Cancer (e.g., Endometrial, etc.), Uterine Sarcoma, Vaginal Cancer, Vulvar Cancer, Waldenström Macroglobulinemia, Wilms Tumor, and the like.

In some instances, a MYC-driven cancer treated according to the methods described herein is a blood cancer (e.g., a leukemia, a lymphoma, etc.), In some instances, a MYC-driven cancer treated according to the methods described herein is a liver cancer (e.g., a hepatocellular cancer, e.g., a hepatocellular carcinoma). In some instances, the neoplasia treated according to the methods described herein is not colon cancer or a tumor thereof. In some instances, the neoplasia treated according to the methods described herein is not breast cancer or a tumor thereof.

In some instances, carcinomas that may be targeted in the subject methods of treatment include e.g., MYC-driven forms of the following: acinar carcinoma, acinic cell carcinoma, acinous carcinoma, adenocystic carcinoma, adenoid cystic carcinoma, adenosquamous carcinoma, adnexal carcinoma, adrenocortical carcinoma, alveolar carcinoma, ameloblastic carcinoma, apocrine carcinoma, basal cell carcinoma, bronchioloalveolar carcinoma, bronchogenic carcinoma, cholangiocellular carcinoma, chorionic carcinoma, clear cell carcinoma, colloid carcinoma, cribriform carcinoma, ductal carcinoma in situ, embryonal carcinoma, carcinoma en cuirasse, endometrioid carcinoma, epidermoid carcinoma, carcinoma ex mixed tumor, carcinoma ex pleomorphic adenoma, follicular carcinoma of thyroid gland, hepatocellular carcinoma, carcinoma in si'tu, intraductal carcinoma, Hürthle cell carcinoma, inflammatory carcinoma of the breast, large cell carcinoma, invasive lobular carcinoma, lobular carcinoma, lobular carcinoma in situ (LCIS), medullary carcinoma, meningeal carcinoma, Merkel cell carcinoma, mucinous carcinoma, mucoepidermoid carcinoma, nasopharyngeal carcinoma, non-small cell carcinoma, non-small cell lung carcinoma (NSCLC), oat cell carcinoma, papillary carcinoma, renal cell carcinoma, scirrhous carcinoma, sebaceous carcinoma, carcinoma sim'plex, signet-ring cell carcinoma, small cell carcinoma, small cell lung carcinoma, spindle cell carcinoma, squamous cell carcinoma, terminal duct carcinoma, transitional cell carcinoma, tubular carcinoma, verrucous carcinoma, and the like.

In some instances, the subject methods of treating a subject for a MYC-driven neoplasia may include a step of identifying the subject's neoplasia as MYC-driven. Any convenient method for identifying a neoplasia as MYC-driven may be employed including but not limited to e.g., measuring MYC expression in a sample of the neoplasia from the subject, detecting a mutation in the subject associated with MYC overexpression, and the like. Measuring MYC expression in a sample of the neoplasia from the subject may be performed in a variety of ways including but not limited to e.g., quantitative PCR, quantitative sequencing, microarray expression profiling, in situ hybridization, quantitative mass spectrometry, immunohistochemistry, and the like. Various mutations associated with MYC overexpression may be detected and such mutations will vary and will include any mutation useful in determining the resulting expression level of a MYC encoding nucleic acid, the expression level of a MYC polypeptide, and/or the activity or function of an encoded MYC polypeptide. Accordingly, mutations associated with MYC overexpression that may be detected will vary any may include but are not limited to e.g., gain-of-function mutations in MYC, mutations that inhibits the activity a MYC repressor, mutations that induce the activity of a MYC activator and the like.

The compositions (e.g., those including one or more inhibitor of a MYC-dependent target gene) of this disclosure can be supplied in the form of a pharmaceutical composition. Any suitable pharmaceutical composition may be employed, described in more detail below. As such, in some instances, methods of the present disclosure may include administering an inhibitor in a composition comprising an excipient (e.g., an isotonic excipient) prepared under sufficiently sterile conditions for administration to a mammal, e.g., a human.

Administration of an inhibitor to a subject, as described herein, may be performed employing various routes of administration. The route of administration may be selected according to a variety of factors including, but not necessarily limited to, the condition to be treated, the formulation and/or device used, the patient to be treated, and the like. Routes of administration useful in the disclosed methods include but are not limited to oral and parenteral routes, such as intravenous (iv), intraperitoneal (ip), rectal, topical, ophthalmic, nasal, and transdermal. Formulations for these dosage forms are described herein.

An effective amount of a subject compound will depend, at least, on the particular method of use, the subject being treated, the severity of the affliction, and the manner of administration of the therapeutic composition. A "therapeutically effective amount" of a composition is a quantity of a specified compound sufficient to achieve a desired effect in a subject (host) being treated.

Therapeutically effective doses of a subject compound or pharmaceutical composition can be determined by one of skill in the art, with a goal of achieving local (e.g., tissue) concentrations that are at least as high as the IC50 of an applicable compound disclosed herein.

The specific dose level and frequency of dosage for any particular subject may be varied and will depend upon a variety of factors, including the activity of the subject compound, the metabolic stability and length of action of that compound, the age, body weight, general health, sex and diet of the subject, mode and time of administration, rate of excretion, drug combination, and severity of the condition of the host undergoing therapy.

Conversion of an animal dose to human equivalent doses (HED) may, in some instances, be performed using the conversion table and/or algorithm provided by the U.S. Department of Health and Human Services, Food and Drug Administration, Center for Drug Evaluation and Research (CDER) in, e.g., *Guidance for Industry: Estimating the Maximum Safe Starting Dose in Initial Clinical Trials for Therapeutics in Adult Healthy Volunteers* (2005) Food and Drug Administration, 5600 Fishers Lane, Rockville, Md. 20857; (available at www(dot)fda(dot)gov/cder/guidance/index(dot)htm, the disclosure of which is incorporated herein by reference).

Conversion of Animal Doses to Human Equivalent Doses Based on Body Surface Area

| Species | To Convert Animal Dose in mg/kg to Dose in mg/m², Multiply by $k_m$ | To Convert Animal Dose in mg/kg to HED[a] in mg/kg, Either: | |
|---|---|---|---|
| | | Divide Animal Dose By | Multiply Animal Dose By |
| Human | 37 | — | — |
| Child (20 kg)[b] | 25 | — | — |
| Mouse | 3 | 12.3 | 0.08 |
| Hamster | 5 | 7.4 | 0.13 |
| Rat | 6 | 6.2 | 0.16 |
| Ferret | 7 | 5.3 | 0.19 |
| Guinea pig | 8 | 4.6 | 0.22 |
| Rabbit | 12 | 3.1 | 0.32 |
| Dog | 20 | 1.8 | 0.54 |
| Primates: | | | |
| Monkeys[c] | 12 | 3.1 | 0.32 |
| Marmoset | 6 | 6.2 | 0.16 |
| Squirrel monkey | 7 | 5.3 | 0.19 |

| Species | To Convert Animal Dose in mg/kg to Dose in mg/m², Multiply by $k_m$ | To Convert Animal Dose in mg/kg to HED[a] in mg/kg, Either: | |
| --- | --- | --- | --- |
| | | Divide Animal Dose By | Multiply Animal Dose By |
| Baboon | 20 | 1.8 | 0.54 |
| Micro-pig | 27 | 1.4 | 0.73 |
| Mini-pig | 35 | 1.1 | 0.95 |

[a] Assumes 60 kg human. For species not listed or for weights outside the standard ranges, HED can be calculated from the following formula: HED = animal dose in mg/kg × (animal weight in kg/human weight in kg)0.33.
[b] This km value is provided for reference only since healthy children will rarely be volunteers for phase 1 trials.
[c] For example, cynomolgus, rhesus, and stumptail.

Pharmaceutical Compositions

A pharmaceutical composition comprising a subject compound (i.e., an inhibitory agent or a combination thereof) may be administered to a patient alone, or in combination with other supplementary active agents. The pharmaceutical compositions may be manufactured using any of a variety of processes, including, without limitation, conventional mixing, dissolving, granulating, dragee-making, levigating, emulsifying, encapsulating, entrapping, and lyophilizing. The pharmaceutical composition can take any of a variety of forms including, without limitation, a sterile solution, suspension, emulsion, lyophilisate, tablet, pill, pellet, capsule, powder, syrup, elixir or any other dosage form suitable for administration.

A subject compound may be administered to the host using any convenient means capable of resulting in the desired reduction in disease condition or symptom. Thus, a subject compound can be incorporated into a variety of formulations for therapeutic administration. More particularly, a subject compound can be formulated into pharmaceutical compositions by combination with appropriate pharmaceutically acceptable carriers or diluents, and may be formulated into preparations in solid, semi-solid, liquid or gaseous forms, such as tablets, capsules, powders, granules, ointments, solutions, suppositories, injections, inhalants and aerosols.

Formulations for pharmaceutical compositions are well known in the art. For example, Remington's Pharmaceutical Sciences, by E. W. Martin, Mack Publishing Co., Easton, Pa., 19th Edition, 1995, describes exemplary formulations (and components thereof) suitable for pharmaceutical delivery of disclosed compounds. Pharmaceutical compositions comprising at least one of the subject compounds can be formulated for use in human or veterinary medicine. Particular formulations of a disclosed pharmaceutical composition may depend, for example, on the mode of administration and/or on the location of the infection to be treated. In some embodiments, formulations include a pharmaceutically acceptable carrier in addition to at least one active ingredient, such as a subject compound. In other embodiments, other medicinal or pharmaceutical agents, for example, with similar, related or complementary effects on the affliction being treated can also be included as active ingredients in a pharmaceutical composition.

Pharmaceutically acceptable carriers useful for the disclosed methods and compositions are conventional in the art. The nature of a pharmaceutical carrier will depend on the particular mode of administration being employed. For example, parenteral formulations usually comprise injectable fluids that include pharmaceutically and physiologically acceptable fluids such as water, physiological saline, balanced salt solutions, aqueous dextrose, glycerol or the like as a vehicle. For solid compositions (e.g., powder, pill, tablet, or capsule forms), conventional non-toxic solid carriers can include, for example, pharmaceutical grades of mannitol, lactose, starch, or magnesium stearate. In addition to biologically neutral carriers, pharmaceutical compositions to be administered can optionally contain minor amounts of non-toxic auxiliary substances (e.g., excipients), such as wetting or emulsifying agents, preservatives, and pH buffering agents and the like; for example, sodium acetate or sorbitan monolaurate. Other non-limiting excipients include, nonionic solubilizers, such as cremophor, or proteins, such as human serum albumin or plasma preparations.

Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, ethyl cellulose and cellulose acetate; (4) powdered tragacanth; (5) malt; (6) gelatin; (7) talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol, and polyethylene glycol; (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; and (22) other non-toxic compatible substances employed in pharmaceutical formulations.

The disclosed pharmaceutical compositions may be formulated as a pharmaceutically acceptable salt of a disclosed compound. Pharmaceutically acceptable salts are non-toxic salts of a free base form of a compound that possesses the desired pharmacological activity of the free base. These salts may be derived from inorganic or organic acids. Non-limiting examples of suitable inorganic acids are hydrochloric acid, nitric acid, hydrobromic acid, sulfuric acid, hydroiodic acid, and phosphoric acid. Non-limiting examples of suitable organic acids are acetic acid, propionic acid, glycolic acid, lactic acid, pyruvic acid, malonic acid, succinic acid, malic acid, maleic acid, fumaric acid, tartaric acid, citric acid, benzoic acid, cinnamic acid, mandelic acid, methanesulfonic acid, ethanesulfonic acid, p-toluenesulfonic acid, methyl sulfonic acid, salicylic acid, formic acid, trichloroacetic acid, trifluoroacetic acid, gluconic acid, asparagic acid, aspartic acid, benzenesulfonic acid, p-toluenesulfonic acid, naphthalenesulfonic acid, and the like. Lists of other suitable pharmaceutically acceptable salts are found in Remington's Pharmaceutical Sciences, 17th Edition, Mack Publishing Company, Easton, Pa., 1985. A pharmaceutically acceptable salt may also serve to adjust the osmotic pressure of the composition.

A subject compound can be used alone or in combination with appropriate additives to make tablets, powders, granules or capsules, for example, with conventional additives, such as lactose, mannitol, corn starch or potato starch; with binders, such as crystalline cellulose, cellulose derivatives, acacia, corn starch or gelatins; with disintegrators, such as corn starch, potato starch or sodium carboxymethylcellulose; with lubricants, such as talc or magnesium stearate; and if desired, with diluents, buffering agents, moistening agents, preservatives and flavoring agents. Such preparations can be used for oral administration.

A subject compound can be formulated into preparations for injection by dissolving, suspending or emulsifying them in an aqueous or nonaqueous solvent, such as vegetable or other similar oils, synthetic aliphatic acid glycerides, esters of higher aliphatic acids or propylene glycol; and if desired, with conventional additives such as solubilizers, isotonic agents, suspending agents, emulsifying agents, stabilizers and preservatives. The preparation may also be emulsified or the active ingredient encapsulated in liposome vehicles. Formulations suitable for injection can be administered by an intravitreal, intraocular, intramuscular, subcutaneous, sublingual, or other route of administration, e.g., injection into the gum tissue or other oral tissue. Such formulations are also suitable for topical administration.

In some embodiments, a subject compound can be delivered by a continuous delivery system. The term "continuous delivery system" is used interchangeably herein with "controlled delivery system" and encompasses continuous (e.g., controlled) delivery devices (e.g., pumps) in combination with catheters, injection devices, and the like, a wide variety of which are known in the art.

A subject compound can be utilized in aerosol formulation to be administered via inhalation. A subject compound can be formulated into pressurized acceptable propellants such as dichlorodifluoromethane, propane, nitrogen and the like.

Furthermore, a subject compound can be made into suppositories by mixing with a variety of bases such as emulsifying bases or water-soluble bases. A subject compound can be administered rectally via a suppository. The suppository can include vehicles such as cocoa butter, carbowaxes and polyethylene glycols, which melt at body temperature, yet are solidified at room temperature.

The term "unit dosage form," as used herein, refers to physically discrete units suitable as unitary dosages for human and animal subjects, each unit containing a predetermined quantity of a subject compound calculated in an amount sufficient to produce the desired effect in association with a pharmaceutically acceptable diluent, carrier or vehicle. The specifications for a subject compound depend on the particular compound employed and the effect to be achieved, and the pharmacodynamics associated with each compound in the host.

The dosage form of a disclosed pharmaceutical composition will be determined by the mode of administration chosen. For example, in addition to injectable fluids, topical or oral dosage forms may be employed. Topical preparations may include eye drops, ointments, sprays and the like. In some instances, a topical preparation of a medicament useful in the methods described herein may include, e.g., an ointment preparation that includes one or more excipients including, e.g., mineral oil, paraffin, propylene carbonate, white petrolatum, white wax and the like, in addition to one or more additional active agents.

Oral formulations may be liquid (e.g., syrups, solutions or suspensions), or solid (e.g., powders, pills, tablets, or capsules). Methods of preparing such dosage forms are known, or will be apparent, to those skilled in the art.

Certain embodiments of the pharmaceutical compositions comprising a subject compound may be formulated in unit dosage form suitable for individual administration of precise dosages. The amount of active ingredient administered will depend on the subject being treated, the severity of the affliction, and the manner of administration, and is known to those skilled in the art. Within these bounds, the formulation to be administered will contain a quantity of the extracts or compounds disclosed herein in an amount effective to achieve the desired effect in the subject being treated.

Each therapeutic compound can independently be in any dosage form, such as those described herein, and can also be administered in various ways, as described herein. For example, the compounds may be formulated together, in a single dosage unit (that is, combined together in one form such as capsule, tablet, powder, or liquid, etc.) as a combination product. Alternatively, when not formulated together in a single dosage unit, an individual subject compound may be administered at the same time as another therapeutic compound or sequentially, in any order thereof.

Kits and Cell Lines

Also provided are kits and cell lines for use in the subject methods. The subject cell lines include neoplastic cell lines (e.g., tumor cell lines, cancer cell lines, etc.) conditionally expressing and/or repressing MYC. In some instances, the subject cell lines conditionally express and/or repress MYC in the presence of tetracycline or an analog of tetracycline, such as but not limited to e.g., doxycycline. Cell lines may include those derived from a MYC-driven neoplasia including e.g., those MYC-driven neoplasms derived from a mammalian neoplasia such as e.g., a human neoplasia, a mouse neoplasia, a rat neoplasia, a primate neoplasia, or the like. In some instances, the MYC-driven neoplasia may be derived from a model organism neoplasia, including MYC-driven model organism neoplasia, e.g., those derived from a mouse model organism neoplasia, a rat model organism neoplasia, a primate model organism neoplasia, or the like. In some embodiments, the subject cell line may be a liver cancer cell line. In some embodiments, the subject cell line may be a blood cancer cell line. In some instances, the cell line may be a carcinoma cell line including but not limited to a liver carcinoma cell line, such as a MYC-drive liver carcinoma cell line. In some instances, the cell line may be a lymphoma cell line or a leukemia cell line such as but not limited to e.g., a MYC-driven Burkitt's lymphoma/leukemia cell line, a MYC-driven T cell lymphoma/leukemia cell line, a MYC-driven B cell lymphoma/leukemia cell line, or the like.

The subject kits may include any combination of components (e.g., reagents, cell lines, etc.) for performing the subject methods, such as e.g., methods of treating a subject for a neoplasm and/or methods of identifying a target gene of a MYC-driven neoplasm.

In some embodiments, a subject kit may be employed in a method of treating a subject for a MYC-driven neoplasm. Such a kits may vary and may, but need not necessarily, include one or more reagents for identifying the neoplasm as a MYC-driven neoplasm and an effective amount of an agent for treating the MYC-driven neoplasm including but not limited to e.g., one or more inhibitors of RNA metabolism (e.g., an inhibitor of RNA transcription amplification, an inhibitor of mRNA splicing, an inhibitor of ribosomal biogenesis, an inhibitor RNA degradation, an inhibitor of RNA transport, or a combination thereof), one or more inhibitors of DNA repair, one or more inhibitors of pyrimidine metabolism, one or more inhibitors of terpenoid backbone biosynthesis, or a combination thereof. In some instances, a kit may include one or more inhibitors of the following RNA transport genes: Acin1, Alyref, Eif3a/b/f, Eif5b, Ncbp1, Ndc1, Nups, Pabpc1, Rbm8a, Seh1l, Sumo2, Thoc1, Upf1, Wibg, Xpo1, Gemin2/7/8, Ncbp1, Ndc1, Nups, Prmt5, Seh1l, Smn1, Xpo1, Ndc1, Nups, Pop1/4/5/7, Rpp25l, Seh1l, Xpo1, Eef1a1, Ndc1, Nups, Rpp21, Seh1l and Trnt1. Therapeutic agents provided in such kits may or may not be configured as a pharmaceutical formulation, in unit dosage form, alone or in combination, e.g., as described in more detail herein.

In some embodiments, a subject kit may be employed in a method of identifying a target gene of a MYC-driven neoplasm. Such kits may vary and may, but need not necessarily, include one or more tumor cell lines that conditionally express/repress MYC in response to the presence/absence of tetracycline or an analog thereof. In some instances, a subject kit may include one or more, including a plurality of or a library of, CRISPR-based gene silencing agents. In some embodiments, the subject kits may include a nucleic acid for expressing a Cas9 polypeptide within a tumor cell line that conditionally expresses/represses MYC in the presence of tetracycline or an analog thereof. In some instances, a cell line contained within a subject kit may be configured (e.g., genetically modified) to express a Cas9 polypeptide.

In addition to the above components, the subject kits and/or cell lines may further include (in certain embodiments) instructions for practicing the subject methods. These instructions may be present in the subject kits or provided with the subject cell lines in a variety of forms, one or more of which may be present in the kit or provided with the subject cell lines. One form in which these instructions may be present is as printed information on a suitable medium or substrate, e.g., a piece or pieces of paper on which the information is printed, in the packaging of the kit or cell line(s), in a package insert, and the like. Yet another form of these instructions is a computer readable medium, e.g., diskette, compact disk (CD), flash drive, and the like, on which the information has been recorded. Yet another form of these instructions that may be present is a website address which may be used via the internet to access the information at a removed site.

Notwithstanding the appended claims, the disclosure is also defined by the following clauses:

1. A method of identifying a MYC-dependent target gene, the method comprising:
    a) contacting a first tumor cell line, conditionally expressing MYC, with a CRISPR-based gene silencing agent targeting a target gene;
    b) contacting a second tumor cell line, conditionally repressing MYC, with the CRISPR-based gene silencing agent; and
    c) detecting a phenotype of the first tumor cell line that is present in or quantitatively different in the second tumor cell line to identify the target gene as a MYC-dependent target gene.
2. The method according to Clause 1, wherein the first and second tumor cell lines conditionally repress MYC in the presence of tetracycline or an analog thereof.
3. The method according to Clauses 1 or 2, wherein the phenotype is present in the first tumor cell line and absent in the second tumor cell line.
4. The method according to Clause 3, wherein the phenotype is cell death.
5. The method according to Clause 3, wherein the phenotype is susceptibility to a cancer therapy.
6. The method according to Clauses 1 or 2, wherein the phenotype is quantitatively decreased in the first tumor cell line as compared to the second tumor cell line.
7. The method according to Clause 6, wherein the phenotype is cell viability.
8. The method according to any of the preceding clauses, wherein the first and second tumor cell lines are carcinoma cancer cell lines.
9. The method according to any of the preceding clauses, wherein the first and second tumor cell lines are liver cancer cell lines.
10. The method according to any of the preceding clauses, wherein the first and second tumor cell lines transiently express a Cas9 nuclease.
11. The method according to any of the preceding clauses, wherein the first and second tumor cell lines stably express a Cas9 nuclease.
12. The method according to any of the preceding clauses, wherein the CRISPR-based gene silencing agent is a guide RNA (gRNA).
13. The method according to any of the preceding clauses, wherein the target gene encodes a protein involved in RNA metabolism.
14. The method according to Clause 13, wherein the protein involved in RNA metabolism is a protein involved in RNA transcription amplification, mRNA splicing, ribosomal biogenesis, RNA transport or RNA degradation.
15. The method according to any of the preceding clauses, wherein the target gene is an RNA transport gene selected from the group consisting of: Acin1, Alyref, Eif3a/b/f, Eif5b, Ncbp1, Ndc1, Nups, Pabpc1, Rbm8a, Seh1l, Sumo2, Thoc1, Upf1, Wibg, Xpo1, Gemin2/7/8, Ncbp1, Ndc1, Nups, Prmt5, Seh1l, Smn1, Xpo1, Ndc1, Nups, Pop1/4/5/7, Rpp25l, Seh1l, Xpo1, Eef1a1, Ndc1, Nups, Rpp21, Seh1l and Trnt1.
16. The method according to any of Clauses 1 to 12, wherein the target gene encodes a protein involved in DNA repair, pyrimidine metabolism, or terpenoid backbone biosynthesis.
17. The method according to any of the preceding clauses, wherein the method comprises contacting the first and second tumor cell lines with a plurality of CRISPR-based gene silencing agents targeting a plurality of target genes and detecting one or more phenotypes of the first tumor cell line that are present in or quantitatively different in the second tumor cell line to identify the plurality of target genes as MYC-dependent target genes.
18. A method of treating a subject for a neoplasia that is MYC-driven, the method comprising administering to the subject an effective amount of an inhibitor of a MYC-dependent target gene identified according to the method of any of Clauses 1 to 17.
19. The method according to Clause 18, wherein the method further comprises identifying the neoplasia as a MYC-driven neoplasia.
20. The method according to Clause 19, wherein the identifying comprises measuring MYC expression in a sample of the neoplasia from the subject.
21. The method according to Clauses 19 or 20, wherein the identifying comprises detecting a mutation in the subject associated with MYC overexpression.
22. The method according to Clause 21, wherein the mutation is a gain-of-function mutation in MYC.
23. The method according to Clause 21, wherein the mutation is a mutation that inhibits the activity a MYC repressor.
24. The method according to Clause 21, wherein the mutation is a mutation that induces the activity of a MYC activator.
25. The method according to any of Clauses 18 to 24, wherein the neoplasia is a neoplasia of the liver or blood.
26. The method according to any of Clauses 18 to 25, wherein the neoplasia is a carcinoma.
27. The method according to any of Clauses 18 to 25, wherein the neoplasia is a lymphoma.
28. A method of treating a subject for neoplasia that is MYC-driven, the method comprising administering to the subject an effective amount of an inhibitor of RNA metabolism.

29. The method according to Clause 28, wherein the inhibitor of RNA metabolism is an inhibitor of RNA transcription amplification.
30. The method according to Clause 28, wherein the inhibitor of RNA metabolism is an inhibitor of mRNA splicing.
31. The method according to Clause 28, wherein the inhibitor of RNA metabolism is an inhibitor of ribosomal biogenesis.
32. The method according to Clause 28, wherein the inhibitor of RNA metabolism is an inhibitor RNA degradation.
33. The method according to Clause 28, wherein the inhibitor of RNA metabolism is an inhibitor of RNA transport.
34. The method according to Clause 33, wherein the inhibitor of RNA transport is an inhibitor of Xpo1.
35. The method according to Clause 34, wherein the inhibitor of Xpo1 is KPT-330.
36. The method according to any of Clauses 28 to 35, wherein the method further comprises identifying the neoplasia as a MYC-driven neoplasia.
37. The method according to Clause 36, wherein the identifying comprises measuring MYC expression in a sample of the neoplasia from the subject.
38. The method according to Clauses 36 or 37, wherein the identifying comprises detecting a mutation in the subject associated with MYC overexpression.
39. The method according to any of Clauses 28 to 38, wherein the neoplasia is a neoplasia of the liver or blood.
40. The method according to any of Clauses 28 to 39, wherein the neoplasia is a carcinoma.
41. The method according to any of Clauses 28 to 39, wherein the neoplasia is a lymphoma.
42. A method of treating a subject for a neoplasia that is MYC-driven, the method comprising administering to the subject an effective amount of an inhibitor of AHR, AURKA, BIRC5, BRD4, CDK9, EP300, HMGCS1, MTOR, PIM3 or PRMT5.
43. The method according to Clause 42, wherein the neoplasia is a neoplasia of the liver or blood.
44. The method according to Clause 42 or 43, wherein the neoplasia is a carcinoma.
45. The method according to Clause 42 or 43, wherein the neoplasia is a lymphoma.
46. The method according to any of Clauses 42 to 45, wherein the method further comprises identifying the neoplasia as a MYC-driven neoplasia.
47. The method according to Clause 46, wherein the identifying comprises measuring MYC expression in a sample of the neoplasia from the subject.
48. The method according to Clauses 46 or 47, wherein the identifying comprises detecting a mutation in the subject associated with MYC overexpression.

EXAMPLES

The following examples are put forth so as to provide those of ordinary skill in the art with a complete disclosure and description of how to make and use the present invention, and are not intended to limit the scope of what the inventors regard as their invention nor are they intended to represent that the experiments below are all or the only experiments performed. Efforts have been made to ensure accuracy with respect to numbers used (e.g. amounts, temperature, etc.) but some experimental errors and deviations should be accounted for. Unless indicated otherwise, parts are parts by weight, molecular weight is weight average molecular weight, temperature is in degrees Celsius, and pressure is at or near atmospheric. Standard abbreviations may be used, e.g., room temperature (RT); base pairs (bp); kilobases (kb); picoliters (pl); seconds (s or sec); minutes (m or min); hours (h or hr); days (d); weeks (wk or wks); nanoliters (nl); microliters (ul); milliliters (ml); liters (L); nanograms (ng); micrograms (ug); milligrams (mg); grams ((g), in the context of mass); kilograms (kg); equivalents of the force of gravity ((g), in the context of centrifugation); nanomolar (nM); micromolar (uM), millimolar (mM); molar (M); amino acids (aa); kilobases (kb); base pairs (bp); nucleotides (nt); intramuscular (i.m.); intraperitoneal (i.p.); subcutaneous (s.c.); and the like.

Example 1: CRISPR Synthetic Lethal Screen Identifies RNA Transport as a Novel Therapeutic Target for MYC Overexpressing Cancer Materials and Methods
CRISPR Library Screening and Data Analysis
The CRISPR library screening was performed following published protocol[14]. The pooled mouse GeCKO v2 CRISPR library containing 130,209 gRNAs was obtained from Addgene. Briefly, the library was amplified by electroporation into the Endura competent cells (Lucigen). After lentiviral packaging of the library, EC4 cells with Cas9 were infected at low viral titers so that approximately 10% of the cells were infected. The infected cells were selected with puromycin (1 µg/ml) for two days before screening.

The gRNA libraries in the screened populations were subsequently isolated by PCR amplification and characterized by hi-seq. Computational extraction of the gRNA from the fastq files was done by removing the barcode, stagger, and primer sequences, and aligning to the GeCKO libraries. Bowtie2 alignment used default parameters. Files were converted to bam format and sorted using samtools. These results were filtered to only include forward-aligning reads without indels to minimize the possibility of miscounting successful alignments. Reads passing filter were counted by reference contig (i.e. the 20mers in the GeCKO libraries) to give counts for each gRNA. Data were plotted using R/gplots.

KPT-330 Treatment In Vivo and Monitoring the Tumor Size
The KPT-330 (Selleckchem) was dissolved in vehicle (1% Pluronic F-68 and 1% PVP-K29/32, 25 mg/kg) was administered by oral gavage to tumor-bearing mice three times a week for 6 doses total. A 7T MRI for small animals was used to image tumor both before and after treatment. Tumor volume was calculated based on the T2 weighted image stacks using the Osirix software. For short-term treatment, the mice were treated with either vehicle or KPT-330 for three doses and sacrificed the following day after the third dose.

mRNA Fluorescent In Situ Hybridization
A standard FISH protocol was used to detect poly(A) in fixed cells. In brief, cells were fixed in 4% formaldehyde in PBS at room temperature for 20 minutes, washed 5 minutes each in PBS and 2×SSC (20×SSC: 3 M sodium chloride, 300 mM sodium citrate, pH=7.0) before applying the probe. The mRNA-specific probe (5'-/5ATTO565N/d(T)$_{30}$-3', from Integrated DNA Technologies) was hybridized at 37 degree for 3h in the dark (200 nM probe in 4×SCC, 0.5 mM EDTA, 10% dextran sulfate, and 10% formamide). Cells were then washed in 2×SSC and PBS (15 minutes each) before mounting. PBS, SSC, and water were treated with 0.1% diethylpyrocarbonate (DEPC) prior use. Images were acquired on a DMI 6000 B (Leica) epifluorescence microscope.

EU-Labeling and Visualization of Total RNA

EC4 cells were labeled with 1 mM 5-ethynyl uridine (EU) for 5h in the presence of 150 nM KPT-330 or vehicle (DMSO control) at 37 degrees and 5% $CO_2$. Cells were then fixed with 4% formaldehyde in PBS at room temperature for 20 minutes, washed consecutively with PBS, 50 mM $NH_4Cl$/PBS, PBS (10 minutes each) and permeabilized with 0.2% TritonX100/PBS. After washing with PBS, EU was labeled with Alexa-647-azide using the Click-IT imaging kit (Invitrogen) following the manufacturer's instructions. Images were acquired on a DMI 6000 B (Leica) epifluorescence microscope. Mean fluorescence intensities in regions of interest in the cytoplasm and in the nucleus omitting nucleoli were determined using ImageJ.

RNA Fractionation and RNA-Seq

EC4 cells were treated with either DMSO or KPT-330 (0.5 µM) in triplicates for 24 hours. RNA was fractionated using the Cytoplasmic & Nuclear RNA Purification kit (Norgen Biotek). RNA-seq was performed commercially by Macrogen. Fragments Per Kilobase of transcript per Million (FPKM) mapped reads were used to measure the abundance of each transcript. For the existing RNA-seq studies, the data were downloaded from Gene Expression Omnibus (GEO). The specific data sets are GSE76062 for primary murine LAP-tTA/tet-O-MYC liver cancer, GSE51008 for Eµ-MYC lymphoma, and GSE40783 for the human P493-6 cell line. The abundance of 34 RNA transport genes and B2M was normalized with the level of ubiquitin C (UBC).

Flow Cytometric Analysis of Apoptosis

For apoptosis staining, cells were stained with 7-AAD and PE-Annexin-V (Becton Dickinson) and analyzed on a FACScan flow cytometer following manufacturer's instructions. FACS data was analyzed with FlowJo software (Tree Star). The apoptotic cell populations were defined by positive staining of both Annexin-V and 7-AAD.

Western Blot and Immunohistochemical Analysis

The following antibodies were used for Western blotting and IHC: MYC (9E10 for Western blot and Epitomics 1472-1 for IHC), Tubulin (Sigma), Cleaved caspase 3 and phospho-Histone H3 (Cell Signaling). Immunofluorescence or bright field pictures were taken with 20× objectives on a Leica DMI6000 B microscope and quantified using MetaMorph image analysis software.

IC50 Determination

Cells were seeded at a density of 1000-2000 cells/well in 96-well plates. Cells were treated with different concentrations of KPT-330 (1:3 dilution from 10 micromolar to 0.33 nanomolar) for 72 hours. MYC expression was shut off by treating the cells with doxycycline (100ng/ml). All experiments were performed in quadruplicates. Cell viability was determined using the CellTiter-Glo Luminescent Cell Viability Assay (Promega). The IC50 was calculated using the Prism software (GraphPad). The log-transformed concentration values and the normalized luminance data were fitted to a four-parameter logistic equation to derive the IC50 value.

Results

CRISPR Genome-Wide Library Screen in a Conditional MYC Expressing Tumor

A CRISPR genome-wide library screen was performed in a conditional MYC expressing tumor cell line. First, a conditional MYC-induced cancer cell line (EC4) was derived from a Tet-regulated mouse model of hepatocellular carcinoma (LAP-tTA/tet-O-MYC)[16]. In the EC4 cell line, the human MYC transgene is overexpressed but its expression can be shut off by treatment with doxycycline. The Cas9 nuclease was introduced into EC4 cells and functionally confirmed to effectively induce mutations at specific genomic loci (FIG. 5). To screen for synthetic lethal interactions with MYC (MYC-SL), 130,209 guide RNAs (gRNAs) targeting 20,611 mouse genes were delivered into the EC4 cells using lentiviral infection at low titers so that each cell contained at most one gRNA (FIG. 1, Panel a)[14]. After selection, all surviving EC4 cells should contain one gRNA but mutations of genes targeted by the gRNAs have not yet occurred. These cells served as the baseline pool and were further passaged and separated into two pools: the SL pool that continued to overexpress MYC and the control pool that was treated with doxycycline to shut off MYC expression. Cells were maintained for one more week to allow for the accumulation of genomic mutations induced by the Cas9/gRNAs and the dropouts of specific gRNAs (FIG. 1, Panel a). The frequency distribution of gRNAs in the baseline, SL, and control pools were examined with deep-seq. The overall gRNA frequency distribution in all three pools were similar (FIG. 1, Panel b), suggesting that no significant drifting in the library representation had occurred during cell culture and screening. Furthermore, significant dropouts in the 1000 non-targeting gRNAs that serve as the internal control of the library screen were not observed.

The frequency of gRNAs in both the SL and control pools was normalized with that of the baseline pool to identify dropouts (FIG. 1, Panel c). By comparing the gRNA frequency in the SL versus control pool, the gRNAs that dropped out only in the SL but not in the control pool were identified (rectangular box in FIG. 1, Panel c). These dropped out gRNAs represent the synthetic lethal targets specific to the tumor cells overexpressing MYC but not to the cells with low MYC. For a gene to be considered as a dropout, a minimum of two out of six gRNAs targeting this specific gene needed to decrease by at least two-fold in frequency. 860 MYC-SL genes were identified that are specifically required by the MYC-overexpressing tumor cells. The 860 MYC-SL identified genes included: Aamp, Aars, Aars2, Abcb7, Aco2, Actg1, Actr10, Adm, Ahr, Akirin2, Aldoa, Alg3, Alg6, Anapc10, Ankrd52, Ap1m1, Api5, Arcn1, Arglu1, Arhgap27, Arl4c, Armc7, Arpc4, Art4, Ascc2, Asf1a, Ash2l, Atad3a, Atf4, Atg14, Atp5a1, Atp5b, Atp5f1, Atp5j2, Atp5k, Atp6v0d1, Atp6v1a, Atp6v1f, Atp8a1, Atp8b3, Atr, Atxn10, B3gnt2, Bap1, Bard1, BC017158, BC052040, Bccip, Bend3, Birc5, Bmpr1a, Bora, Brat1, Brd4, Brd9, Brf2, Bricd5, Brpf1, C1d, Cacnb3, Cad, Caprin2, Ccdc101, Ccdc115, Ccdc130, Ccna2, Ccnc, Ccnd1, Ccnh, Cct8, Cd151, Cdc123, Cdc26, Cdc42, Cdc45, Cdca3, Cdca7l, Cdh1, Cdk2ap2, Cdk9, Cdkl3, Ceacam11, Cebpb, Cenpe, Chaf1b, Chchd4, Chka, Chmp1a, Chordc1, Ciao1, Cinp, Cirh1a, Ckap5, Clcc1, Cmpk1, Cnot10, Cog6, Cog7, Commd1, Commd3, Copg1, Cops2, Cops3, Cox17, Cox7c, Cpsf3, Crcp, Crebbp, Cs, Cse1l, Csprs, Ctbp2, Cwc22, D2Wsu81e, Dars2, Dazap1, Dbr1, Dclre1b, Dcps, Dctn3, Dctn6, Ddb2, Ddi2, Ddost, Ddx1, Ddx10, Ddx17, Ddx21, Ddx31, Ddx39, Ddx51, Ddx52, Ddx55, Ddx59, Decr2, Dgkq, Dhodh, Dhx33, Dhx35, Dhx9, Dip2a, Dis3, Dkc1, Dlgap3, Dmap1, Dnajc11, Dnajc2, Dnm2, Dnpep, Dnttip1, Dohh, Dpagt1, Dph1, Dph2, Dph5, Dph6, Dpm2, Dscc1, Dtx3, Dtymk, Dusp12, Dut, Dynll1, Dynlrb1, Dynlt1aa, E2f2, E2f3, Earl 1, Ears2, Ebna1bp2, Ect2, Eed, Eef2, Ehmt1, Eif1ad, Eif2s3x, Eif3j1, Elof1, Elp4, Emc1, Eno1, Ep300, Ercc2, Ercc3, Erdr1, Erh, Esf1, Exoc3, Exoc8, Exosc2, Exosc7, Eya2, F8a, Fam210a, Fam83d, Fam96a, Fam96b, Fam98b, Fance, Farsb, Fbxo11, Fbxo5, Fdx1l, Fdxr, Fermt2, Fgf5, Fkbp2, Fkbp4, Fosll, Fpgs, Frg1, Ftsj3, Fus, Fut1, Fxn, G3bp1, Gabrq, Gadd45g, Gapdh, Gar1, Gatad2a, Gatc, Gclc, Gfer, Gfm1, Gigyf1, Gins1, Gins3, Gins4, Glul, Gmnn, Gmppb, Gpatch1, Gpkow, Gpn3, Gpr111, Gpr137b, Gps1, Gps2, Grpel1, Gsn, Gtf2b, Gtf2f2, Gtf2h3, Gtf3c4, Gtf3c5, Gtpbp4, H2afz, Hars, Haus1, Hbbbh1, Hccs, Hdac2, Heatr3, Hectd2, Hes6, Hiat1, Hinfp, Hira, Hist1 hid, Hist1h2ac, Hist1h2ae, Hist1h2ag, Hist1h2ai, Hist1h2ao, Hist1h2ap, Hist1h2bc, Hist1h2be, Hist1h2bg, Hist1h2bh, Hist1h2bl, Hist1h2bm, Hist1h2bq, Hist1h2br, Hist1h3a, Hist1h3c, Hist1h3i, Hist1h4a, Hist1h4j, Hist1h4k, Hist1h4m, Hist1h4n, Hist2h2be, Hmgcs1, Hmmr, Hnf1a, Hnrnpa1, Hnrnpf, Hnrnpl, Hnrnpu, Hpcal1, Hscb, Hsd17b10, Hsp90ab1, Hspe1, Hus1, Huwe1, Hyou1, Hypk, Iars2, Ibsp, Idh3a, Idi1, Ikbkap, Ilf2, Imp3, Imp4, Inpp5a, Ints4, Kansl2, Kars, Katnb1, Kcng3, Kctd7, Kdm2a, Keap1, Kif18b, Kif20a, Kif23, Kif2c, Kmt2a, Kntc1, Krr1, Krt9, Krtap4-13, Krtap5-5, Kti12, Lamtor1, Lamtor2, Lamtor5, Lars2, Lbh, Lce3c, Lemd2, Lin37, Lin52, Lipe, Lrch3, Lrrc10b, Lrrc59, Lsm10, Lsm11, Lsm5, Lsm7, Ltbp3, Luc7l3, Lyrm4, Maea, Map1lc3a, Mapk1, Mars2, Mbtd1, Mbtps1, Mbtps2, Mcm10, Mcm3, Mcm5, Mcm6, Mcmbp, Mctp1, Mdn1, Med10, Med12, Med13, Med18, Med21, Med23, Med26, Med8, Mesdc2, Metap1, Mettl14, Mettl16, Mettl22, Mfap3, Mfn1, Mfsd10, Mfsd7b, Minos1, Mis12, Mlxip, Mmadhc, Mmp28, Mms19, Mnt, Mob1b, Mob3c, Mpdu1, Mplkip, Mpped2, Mprip, Mre11a, Mrp63, Mrpl12, Mrpl13, Mrpl20, Mrpl21, Mrpl23, Mrpl36, Mrpl39, Mrpl4, Mrpl41, Mrpl49, Mrpl51, Mrpl52, Mrps18a, Mrps18b, Mrps21, Mrps31, Msl1, Msn, Mta2, Mtch2, Mtor, Mtx2, Mup14, Mvd, Mybbp1a, Mybl2, N6amt1, Naa50, Naca, Nacc2, Nars2, Ncapd2, Ncaph2, Ndc80, Ndnl2, Ndufb4, Ndufv1, Nek8, Nelfb, Nelfcd, Nexn, Ngdn, Nhlrc2, Nipbl, Nme3, Nob1, Noc3l, Nol6, Nol9, Nop10, Nop16, Nop56, Nprl3, Nsa2, Nsmce2, Nsmce4a, Ntng2, Nudt5, Nufip2, Numa1, Nup153, Nup93, Nus1, Odf1, Olfr131, Olfr1355, Olfr1414, Olfr181, Olfr523, Olfr77, Olfr818, Olfr98, Onecut2, Orc3, Orc4, Orc5, Osbpl7, Osbpl8, Otud5, P2rx3, Paf1, Pak1ip1, Pak2, Pcnt, Pcnxl3, Pdap1, Pdcd10, Pdcd11, Pdcd7, Pdcl, Pdhb, Pes1, Pfas, Pfdn1, Pfdn4, Pfdn5, Pgam1, Pgap2, Pgd, Pgp, Pgs1, Phf6, Phip, Pi4ka, Pi4kb, Piga, Pigm, Pik3r4, Pla2g7, Plk4, Plxnb3, Pmpcb, Pno1, Pnpt1, Pold1, Pold2, Pold3, Polr1b, Polr1c, Polr1e, Polr2g, Polr2j, Polr2l, Polr3k, Ppara, Ppil4, Ppp1r15b, Ppp1r16b, Ppp2r1a, Ppp2r2d, Ppp2r4, Ppp4c, Ppp4r1, Ppwd1, Pramel7, Prkcb, Prkcsh, Prkrir, Prmt1, Prmt5, Prpf8, Prr19, Prr3, Psmb1, Psmb4, Psmb6, Psmb7, Ptcd3, Ptma, Ptpmt1, Ptpn1, Pvrl2, Pxmp2, Pyroxd1, Qrsl1, Rab35, Rab6a, Rab7, Rabl6, Rad21, Rad51, Rad9a, Ranbp3, Rars, Rbbp4, Rbm8a, Rce1, Recql4, Rfc2, Rfc4, Rfc5, Rfpl4b, Rhox2f, Ric8, Rnf138rt1, Rngtt, Romo1, Rpa2, Rpa3, Rpl13a, Rpl14, Rpl26, Rpl3, Rpl31, Rpl32, Rpl35a, Rpl36al, Rpl37a, Rpl39, Rpl5, Rpl7, Rplp1, Rps10, Rps12, Rps15a, Rps19, Rps21, Rps25, Rps28, Rps3a1, Rps6, Rps8, Rpsa, Rptor, Rrm1, Rrp12, Rrp15, Rsrc2, Rtfdc1, S100a2, S1pr4, Sae1, Safb2, Sall2, Samm50, Sbds, Sbno1, Scd2, Sdad1, Sdhd, Sec22b, Sel1l, Sema4f, Sema7a, Sf3a1, Sf3a2, Sf3a3, Sf3b5, Sh3bgr, Shq1, Sirt6, Sirt7, Slc22a30, Slc25a26, Slc25a3, Slc25a41, Slc35a2, Slc35b1, Slc35b2, Slc3a2, Slc7a6os, Slk, Smarcd1, Smc1a, Smc2, Smg7, Smndc1, Snapin, Snf8, Snrnp35, Snrpa1, Snrpd2, Snrpf, Snx15, Sod1, Son, Sp3, Spata5l1, Spcs1, Spint4, Sprr2d, Srek1, Srp14, Srp72, Srp9, Srsf3, Srsf7, Ss18, Ssb, Stag2, Stub1, Stxbp3a, Sumo2, Supt16, Sympk, Syt14, Syvn1, Tada1, Tada3, Taf1, Taf10, Taf11, Taf13, Taf1c, Taf2, Taf3, Taf6l, Taf7, Tapt1, Tardbp, Tbcb, Tbp, Tdrd12, Telo2, Tenm2, Tfap4, Tfb2m, Tgif1, Timm10, Timm17b, Timm23, Tinf2, Tlk2, Tlx3, Tma16, Tmem165, Tmem199, Tmem200b, Tmem223, Tmem41b, Tmx1, Tmx2, Tnpo1, Tnpo3, Toe1, Tom1l2, Tomm22, Tomm40, Top3a, Tor1aip1, Tpi1, Tpm2, Tra2b, Traip, Trappc3, Trim2, Trim66, Trmt112, Trmt5, Trmt6, Trmt61a, Tsen15, Tsr2, Tssc1, Tssc4, Ttc1, Ttc23, Ttc27, Ttc4, Ttf1, Ttf2, Tti2, Ttl, Ttll4, Tubb4a, Tubb5, Tufm, Tut1, Txn1, Txndc15, Tyms, U2af2, Uba2, Uba3, Uba5, Ubap2l, Ube2l3, Ube2m, Ubr4, Ubtf, Uhrf1, Uqcc2, Uqcrb, Urb1, Uri1, Urod, Uso1, Usp37, Usp5, Usp7, Utp18, Utp23, Uxt, Vac14, Vbp1, Vcp, Vdac1, Vimp, Vmn1r101, Vmn1r116, Vmn1r117, Vmn1r119, Vmn1r129, Vmn1r135, Vmn1r157, Vmn1r165, Vmn1r175, Vmn1r210, Vmn1r50, Vmn1r94, Vmn2r35, Vmn2r49, Vmp1, Vps11, Vps18, Vps25, Vps29, Vps33a, Vps39, Vps45, Vps54, Vwa9, Wars, Wars2, Wdhd1, Wdr16, Wdr43, Wdr46, Wdr5, Wdr55, Wdr73, Wdr75, Wdr77, Wdr82, Wnk1, Xrcc3, Xrn2, Yae1d1, Yap1, Zbed4, Zbtb22, Zbtb7a, Zc3h18, Zdhhc18, Zfhx3, Zfp207, Zfp532, Zfp687, Zfp750, Zfr, Znhit2, Znhit3, Znhit6, Znrd1, Zscan4d, Zwilch and Zzz3.

The MYC-SL gene list was further analyzed for overrepresented molecular pathways which revealed that many pathways, such as ribosomal biogenesis, RNA transport, RNA transcription, spliceosome, aminoacyl-tRNA biosynthesis, pyrimidine metabolism, cell cycle and DNA replication, DNA repair, mRNA surveillance and RNA degradation, and terpenoid backbone biosynthesis are required by MYC overexpressing tumors (FIG. 1, Panel d and Table 1). This analysis identified cellular processes that are essential in MYC-driven cancers.

TABLE 1

| p-value | pathway | members_input_overlap | members_input_overlap_geneids | size | Effective_size |
|---|---|---|---|---|---|
| 2.1E-13 | Ribosome - *Homo sapiens* (human) | RPS12; RPL37A; MRPL21; MRPL20; MRPL23; RPL7; RPLP1; RPL5; RPL35A; RPS15A; RPS6; RPS10; MRPL13; RPL36AL; MRPS21; RPS8; RPL26; RPL13A; RPS19; MRPL36; MRPL12; RPS25; RPS21; MRPS18A; RPS28; RPL3; RPL14; MRPL4; RPSA; RPL39; RPL32; RPL31 | 6150; 6154; 6161; 6165; 6166; 6168; 6170; 6176; 6182; 6194; 6202; 6204; 6206; 6210; 6223; 6227; 6230; 6234; 6160; 54460; 55052; 219927; 28998; 3921; 9045; 55168; 51073; 64979; 23521; 6122; 6125; 6129 | 137 | 135 |
| 8.0E-12 | RNA transport - *Homo sapiens* (human) | SMN1; NCBP1; SEH1L; EEF1A1; SUMO2; UPF1; NDC1; EIF5B; XPO1; RBM8A; EIF3A; EIF3B; EIF3F; NUP43; PABPC1; NUP133; RPP21; NUP160; ACIN1; NUP93; ALYREF; PRMT5; RPP25L; THOC1; GEMIN8; GEMIN2; GEMIN7; NUP153; WIBG; POP1; POP7; POP5; POP4; TRNT1 | 10248; 81929; 10775; 79897; 4686; 51367; 54960; 10419; 10940; 9939; 23279; 9972; 8661; 9984; 8665; 8487; 348995; 84305; 5976; 7514; 26986; 1915; 79760; 51095; 55706; 55746; 9669; 22985; 10189; 6606; 6613; 8662; 9688; 138716 | 172 | 171 |

TABLE 1-continued

| p-value | pathway | members_input_overlap | members_input_overlap_geneids | size | Effective_size |
|---|---|---|---|---|---|
| 3.5E−09 | Basal transcription factors - *Homo sapiens* (human) | TAF7; TAF13; TAF3; TAF2; TAF6L; GTF2F2; GTF2H3; TBP; ERCC2; ERCC3; GTF2B; TAF1; TAF11; TAF10; CCNH | 10629; 902; 2967; 2959; 2963; 83860; 6873; 2068; 6872; 6879; 6881; 6882; 6884; 2071; 6908 | 45 | 45 |
| 1.7E−07 | Aminoacyl-tRNA biosynthesis - *Homo sapiens* (human) | QRSL1; KARS; IARS2; EARS2; NARS2; AARS; WARS2; WARS; MARS2; FARSB; RARS; DARS2; AARS2; LARS2; HARS; GATC | 92935; 55699; 16; 3735; 57505; 3035; 124454; 7453; 5917; 283459; 10056; 55278; 10352; 79731; 55157; 23395 | 66 | 66 |
| 3.0E−07 | Pyrimidine metabolism - *Homo sapiens* (human) | POLR1E; POLD1; ZNRD1; NME3; CMPK1; PNPT1; POLD2; TYMS; POLR1B; POLR1C; DTYMK; DHODH; RRM1; POLR2G; POLR2L; POLD3; POLR2J; DUT; POLR3K; CAD | 51727; 51728; 6240; 30834; 7298; 87178; 1723; 84172; 4832; 790; 1841; 5424; 5425; 5436; 9533; 5439; 5441; 1854; 64425; 10714 | 105 | 104 |
| 3.4E−07 | Cell cycle - *Homo sapiens* (human) | HDAC2; ATR; CCNA2; ANAPC10; GADD45G; SMC1A; RAD21; STAG2; ORC4; ORC5; ORC3; MCM6; MCM5; MCM3; EP300; E2F3; E2F2; CCND1; CDC26; CDC45; CCNH; CREBBP | 545; 23595; 8243; 4172; 1387; 4175; 595; 8318; 10393; 10912; 5885; 1870; 1871; 890; 902; 5000; 5001; 246184; 4174; 10735; 2033; 3066 | 124 | 124 |
| 4.7E−07 | Nucleotide excision repair - *Homo sapiens* (human) | GTF2H3; RFC4; ERCC2; ERCC3; RFC5; RFC2; POLD1; POLD2; POLD3; RPA3; DDB2; RPA2; CCNH | 902; 2071; 2967; 5424; 5425; 10714; 5982; 5984; 5985; 6118; 6119; 1643; 2068 | 47 | 47 |
| 1.2E−06 | Spliceosome - *Homo sapiens* (human) | NCBP1; SF3B5; SNRPA1; PRPF8; SRSF7; RBM8A; SRSF3; U2AF2; HNRNPU; SF3A1; SF3A2; SF3A3; TRA2B; LSM7; SMNDC1; LSM5; HNRNPA1; ALYREF; THOC1; SNRPF; SNRPD2; ACIN1 | 10285; 10291; 11338; 4686; 23658; 3192; 3178; 10946; 9939; 9984; 6428; 6432; 6434; 10594; 6636; 22985; 10189; 6627; 6633; 51690; 8175; 83443 | 133 | 133 |
| 1.2E−06 | DNA replication - *Homo sapiens* (human) | MCM6; RFC5; RFC4; MCM5; RPA3; RFC2; POLD1; POLD2; POLD3; MCM3; RPA2 | 5424; 5425; 5985; 4175; 4172; 4174; 10714; 5982; 5984; 6118; 6119 | 36 | 36 |
| 9.9E−06 | Homologous recombination - *Homo sapiens* (human) | MRE11A; RPA3; RPA2; POLD1; POLD2; POLD3; RAD51; XRCC3; TOP3A | 5888; 4361; 5424; 5425; 10714; 7517; 6118; 6119; 7156 | 29 | 29 |
| 1.2E−05 | Mismatch repair - *Homo sapiens* (human) | RFC5; RFC4; RPA3; RFC2; POLD1; POLD2; POLD3; RPA2 | 5424; 5425; 10714; 5982; 5984; 5985; 6118; 6119 | 23 | 23 |
| 6.1E−05 | mRNA surveillance pathway - *Homo sapiens* (human) | PPP2R1A; SMG7; SYMPK; NCBP1; DAZAP1; PPP2R2D; ACIN1; ALYREF; WIBG; UPF1; WDR82; PABPC1; RNGTT; CPSF3; RBM8A | 8732; 55844; 4686; 9887; 9939; 84305; 5976; 26986; 5518; 26528; 22985; 10189; 80335; 51692; 8189 | 91 | 91 |
| 5.6E−04 | RNA degradation - *Homo sapiens* (human) | DCPS; LSM7; PABPC1; PNPT1; CNOT10; C1D; ENO1; DIS3; XRN2; LSM5; EXOSC2; EXOSC7 | 22803; 28960; 25904; 87178; 51690; 10438; 2023; 23016; 26986; 23404; 22894; 23658 | 77 | 77 |
| 4.6E−03 | Terpenoid backbone biosynthesis - *Homo sapiens* (human) | MVD; HMGCS1; RCE1; IDI1; NUS1 | 9986; 116150; 3157; 3422; 4597 | 22 | 22 |
| 2.1E−13 | Ribosome - *Homo sapiens* (human) | RPS12; RPL37A; MRPL21; MRPL20; MRPL23; RPL7; RPLP1; RPL5; RPL35A; RPS15A; RPS6; RPS10; MRPL13; RPL36AL; MRPS21; RPS8; RPL26; RPL13A; RPS19; MRPL36; MRPL12; RPS25; RPS21; MRPS18A; RPS28; RPL3; RPL14; MRPL4; RPSA; RPL39; RPL32; RPL31 | 6150; 6154; 6161; 6165; 6166; 6168; 6170; 6176; 6182; 6194; 6202; 6204; 6206; 6210; 6223; 6227; 6230; 6234; 6160; 54460; 55052; 219927; 28998; 3921; 9045; 55168; 51073; 64979; 23521; 6122; 6125; 6129 | 137 | 135 |

Representative corresponding protein database identifiers and amino acid sequences for the gene IDs represented in Table 2 (in addition to those previously provided above) include: Entrez GeneID 6150 (UniProtID Q16540; SEQ ID NO:107), Entrez GeneID 6154 (UniProtID P61254; SEQ ID NO:108), Entrez GeneID 6161 (UniProtID P62910; SEQ ID NO:109), Entrez GeneID 6165 (UniProtID P18077; SEQ ID NO:110), Entrez GeneID 6166 (UniProtID O96900; SEQ ID NO:111), Entrez GeneID 6168 (UniProtID P61513; SEQ ID NO:112), Entrez GeneID 6170 (UniProtID P62891; SEQ ID NO:113), Entrez GeneID 6176 (UniProtID P05386; SEQ ID NO:114), Entrez GeneID 6182 (UniProtID P52815; SEQ ID NO:115), Entrez GeneID 6194 (UniProtID P62753; SEQ ID NO:116), Entrez GeneID 6202 (UniProtID P62241; SEQ ID NO:117), Entrez GeneID 6204 (UniProtID P46783; SEQ ID NO:118), Entrez GeneID 6206 (UniProtID P25398; SEQ ID NO:119), Entrez GeneID 6210 (UniProtID P62244; SEQ ID NO:120), Entrez GeneID 6223 (UniProtID P39019; SEQ ID NO:121), Entrez GeneID 6227 (UniProtID P63220; SEQ ID NO:122), Entrez GeneID 6230 (UniProtID P62851; SEQ ID NO:123), Entrez GeneID 6234 (UniProtID P62857; SEQ ID NO:124), Entrez GeneID 6160 (UniProtID P62899; SEQ ID NO:125), Entrez GeneID 54460 (UniProtID P82921; SEQ ID NO:126), Entrez GeneID 55052 (UniProtID Q9BYC9; SEQ ID NO:127), Entrez GeneID 219927 (UniProtID Q7Z2W9; SEQ ID NO:128), Entrez GeneID 28998 (UniProtID Q9BYD1; SEQ ID NO:129), Entrez GeneID 3921 (UniProtID P08865; SEQ ID NO:130), Entrez GeneID 9045 (UniProtID P50914; SEQ ID NO:131), Entrez GeneID 55168 (UniProtID Q9NVS2; SEQ ID NO:132), Entrez GeneID 51073 (UniProtID Q9BYD3; SEQ ID NO:133), Entrez GeneID 64979 (UniProtID Q9P0J6; SEQ ID NO:134), Entrez GeneID 6125 (UniProtID P46777; SEQ ID NO:135), Entrez GeneID 6129 (UniProtID P18124; SEQ ID NO:136), Entrez GeneID 10248 (UniProtID O75817; SEQ ID NO:137), Entrez GeneID 81929 (UniProtID Q96EE3; SEQ ID NO:138), Entrez GeneID 10775 (UniProtID O95707; SEQ ID NO:139), Entrez GeneID 79897 (UniProtID Q9H633; SEQ ID NO:140), Entrez GeneID 4686 (UniProtID Q09161; SEQ ID NO:141), Entrez GeneID 51367 (UniProtID Q969H6; SEQ ID NO:142), Entrez GeneID 54960 (UniProtID Q9NWZ8; SEQ ID NO:143), Entrez GeneID 10940 (UniProtID Q99575; SEQ ID NO:144), Entrez GeneID 9939 (UniProtID Q9Y5S9; SEQ ID NO:145), Entrez GeneID 23279 (UniProtID Q12769; SEQ ID NO:146), Entrez GeneID 9972 (UniProtID P49790; SEQ ID NO:147), Entrez GeneID 8661 (UniProtID Q14152; SEQ ID NO:148), Entrez GeneID 9984 (UniProtID Q96FV9; SEQ ID NO:149), Entrez GeneID 8665 (UniProtID O00303; SEQ ID NO:150), Entrez GeneID 8487 (UniProtID O14893; SEQ ID NO:151), Entrez GeneID 348995 (UniProtID Q8NFH3; SEQ ID NO:152), Entrez GeneID 84305 (UniProtID Q9BRP8; SEQ ID NO:153), Entrez GeneID 5976 (UniProtID Q92900; SEQ ID NO:154), Entrez GeneID 7514 (UniProtID O14980; SEQ ID NO:155), Entrez GeneID 26986 (UniProtID P11940; SEQ ID NO:156), Entrez GeneID 1915 (UniProtID P68104; SEQ ID NO:157), Entrez GeneID 79760 (UniProtID Q9H840; SEQ ID NO:158), Entrez GeneID 51095 (UniProtID Q96Q11; SEQ ID NO:159), Entrez GeneID 55706 (UniProtID Q9BTX1; SEQ ID NO:160), Entrez GeneID 55746 (UniProtID Q8WUM0; SEQ ID NO:161), Entrez GeneID 9669 (UniProtID O60841; SEQ ID NO:162), Entrez GeneID 22985 (UniProtID Q9UKV3; SEQ ID NO:163), Entrez GeneID 10189 (UniProtID Q86V81; SEQ ID NO:164), Entrez GeneID 6606 (UniProtID Q16637; SEQ ID NO:165), Entrez GeneID 6613 (UniProtID P61956; SEQ ID NO:166), Entrez GeneID 8662 (UniProtID P55884; SEQ ID NO:167), Entrez GeneID 9688 (UniProtID Q8N1F7; SEQ ID NO:168), Entrez GeneID 138716 (UniProtID Q8N5L8; SEQ ID NO:169), Entrez GeneID 10629 (UniProtID Q9Y6J9; SEQ ID NO:170), Entrez GeneID 902 (UniProtID P51946; SEQ ID NO:171), Entrez GeneID 2967 (UniProtID Q13889; SEQ ID NO:172), Entrez GeneID 2959 (UniProtID Q00403; SEQ ID NO:173), Entrez GeneID 2963 (UniProtID P13984; SEQ ID NO:174), Entrez GeneID 83860 (UniProtID Q5VWG9; SEQ ID NO:175), Entrez GeneID 6873 (UniProtID Q6P1X5; SEQ ID NO:176), Entrez GeneID 6872 (UniProtID P21675; SEQ ID NO:177), Entrez GeneID 6879 (UniProtID Q15545; SEQ ID NO:178), Entrez GeneID 6881 (UniProtID Q12962; SEQ ID NO:179), Entrez GeneID 6882 (UniProtID Q15544; SEQ ID NO:180), Entrez GeneID 6884 (UniProtID Q15543; SEQ ID NO:181), Entrez GeneID 2071 (UniProtID P19447; SEQ ID NO:182), Entrez GeneID 6908 (UniProtID P20226; SEQ ID NO:183), Entrez GeneID 92935 (UniProtID Q96GW9; SEQ ID NO:184), Entrez GeneID 5917 (UniProtID P54136; SEQ ID NO:185), Entrez GeneID 283459 (UniProtID O43716; SEQ ID NO:186), Entrez GeneID 55278 (UniProtID Q9H0R6; SEQ ID NO:187), Entrez GeneID 51728 (UniProtID Q9Y2Y1; SEQ ID NO:188), Entrez GeneID 30834 (UniProtID Q9P1U0; SEQ ID NO:189), Entrez GeneID 87178 (UniProtID Q8TCS8; SEQ ID NO:190), Entrez GeneID 84172 (UniProtID Q9H9Y6; SEQ ID NO:191), Entrez GeneID 4832 (UniProtID Q13232; SEQ ID NO:192), Entrez GeneID 5424 (UniProtID P28340; SEQ ID NO:193), Entrez GeneID 5425 (UniProtID P49005; SEQ ID NO:194), Entrez GeneID 5436 (UniProtID P62487; SEQ ID NO:195), Entrez GeneID 9533 (UniProtID O15160; SEQ ID NO:196), Entrez GeneID 5439 (UniProtID P52435; SEQ ID NO:197), Entrez GeneID 5441 (UniProtID P62875; SEQ ID NO:198), Entrez GeneID 1854 (UniProtID P33316; SEQ ID NO:199), Entrez GeneID 64425 (UniProtID Q9GZS1; SEQ ID NO:200), Entrez GeneID 10714 (UniProtID Q15054; SEQ ID NO:201), Entrez GeneID 23595 (UniProtID Q9UBD5; SEQ ID NO:202), Entrez GeneID 8243 (UniProtID Q14683; SEQ ID NO:203), Entrez GeneID 4172 (UniProtID P25205; SEQ ID NO:204), Entrez GeneID 4175 (UniProtID Q14566; SEQ ID NO:205), Entrez GeneID 8318 (UniProtID O75419; SEQ ID NO:206), Entrez GeneID 10393 (UniProtID Q9UM13; SEQ ID NO:207), Entrez GeneID 10912 (UniProtID O95257; SEQ ID NO:208), Entrez GeneID 5885 (UniProtID O60216; SEQ ID NO:209), Entrez GeneID 1870 (UniProtID Q14209; SEQ ID NO:210), Entrez GeneID 1871 (UniProtID O00716; SEQ ID NO:211), Entrez GeneID 5000 (UniProtID O43929; SEQ ID NO:212), Entrez GeneID 5001 (UniProtID O43913; SEQ ID NO:213), Entrez GeneID 246184 (UniProtID Q8NHZ8; SEQ ID NO:214), Entrez GeneID 4174 (UniProtID P33992; SEQ ID NO:215), Entrez GeneID 10735 (UniProtID Q8N3U4; SEQ ID NO:216), Entrez GeneID 5982 (UniProtID P35250; SEQ ID NO:217), Entrez GeneID 5984 (UniProtID P35249; SEQ ID NO:218), Entrez GeneID 5985 (UniProtID P40937; SEQ ID NO:219), Entrez GeneID 6118 (UniProtID P15927; SEQ ID NO:220), Entrez GeneID 6119 (UniProtID P35244; SEQ ID NO:221), Entrez GeneID 1643 (UniProtID Q92466; SEQ ID NO:222), Entrez GeneID 10285 (UniProtID O75940; SEQ ID NO:223), Entrez GeneID 10291 (UniProtID Q15459; SEQ ID NO:224), Entrez GeneID 11338 (UniProtID P26368; SEQ ID NO:225), Entrez GeneID 23658 (UniProtID Q9Y4Y9; SEQ ID NO:226), Entrez GeneID 3192 (UniProtID Q00839; SEQ ID NO:227), Entrez GeneID 3178 (UniProtID P09651; SEQ ID NO:228), Entrez GeneID 10946 (UniProtID Q12874; SEQ ID NO:229), Entrez GeneID 6428 (UniProtID P84103; SEQ ID NO:230), Entrez GeneID 6432 (UniProtID Q16629; SEQ ID NO:231), Entrez GeneID 6434 (UniProtID P62995; SEQ ID NO:232), Entrez GeneID 10594 (UniProtID Q6P2Q9; SEQ ID NO:233), Entrez GeneID 6636 (UniProtID P62306; SEQ ID NO:234), Entrez GeneID 6627 (UniProtID P09661; SEQ ID NO:235), Entrez GeneID 6633 (UniProtID P62316; SEQ ID NO:236), Entrez GeneID 51690 (UniProtID Q9UK45; SEQ ID NO:237), Entrez GeneID 8175 (UniProtID Q15428; SEQ ID NO:238), Entrez GeneID 83443 (UniProtID Q9BWJ5; SEQ ID NO:239), Entrez GeneID 4361 (UniProtID P49959; SEQ ID NO:240), Entrez GeneID 7156 (UniProtID Q13472; SEQ ID NO:241), Entrez GeneID 8732 (UniProtID O60942; SEQ ID NO:242), Entrez GeneID 55844 (UniProtID Q66LE6; SEQ ID NO:243), Entrez GeneID 9887 (UniProtID Q92540;

SEQ ID NO:244), Entrez GeneID 26528 (UniProtID Q96EP5; SEQ ID NO:245), Entrez GeneID 80335 (UniProtID Q6UXN9; SEQ ID NO:246), Entrez GeneID 51692 (UniProtID Q9UKF6; SEQ ID NO:247), Entrez GeneID 8189 (UniProtID Q92797; SEQ ID NO:248), Entrez GeneID 22803 (UniProtID Q9H0D6; SEQ ID NO:249), Entrez GeneID 25904 (UniProtID Q9H9A5; SEQ ID NO:250), Entrez GeneID 10438 (UniProtID Q13901; SEQ ID NO:251), Entrez GeneID 2023 (UniProtID P06733; SEQ ID NO:252), Entrez GeneID 23016 (UniProtID Q15024; SEQ ID NO:253), Entrez GeneID 23404 (UniProtID Q13868; SEQ ID NO:254), Entrez GeneID 22894 (UniProtID Q9Y2L1; SEQ ID NO:255), Entrez GeneID 9986 (UniProtID Q9Y256; SEQ ID NO:256), Entrez GeneID 116150 (UniProtID Q96E22; SEQ ID NO:257), Entrez GeneID 3422 (UniProtID Q13907; SEQ ID NO:258), and Entrez GeneID 4597 (UniProtID P53602; SEQ ID NO:259).

Expression of the MYC-SL RNA Transport Genes is Upregulated by MYC

RNA metabolism pathways are the most notable and frequent changes identified in this screen as shown by Kyoto Encyclopedia of Genes and Genomes (KEGG) pathway analysis. For example, the screen identified multiple hits within cellular processes of RNA metabolism, such as ribosomal biogenesis[13], aminoacyl-tRNA biosynthesis[24], RNA transcription[25-27], mRNA splicing[12,22], RNA transport, and mRNA surveillance and degradation[28] (FIG. 1, Panel d). An interesting key processes identified in this analysis, namely RNA transport, ranked as the second most significant changes by KEGG pathway analysis. RNA transport has not been exploited previously in MYC-driven cancers. 34 genes, representing 20% of all 171 genes involved in RNA transport, were identified in the screening hits (FIG. 2, Panel a and Table 1). These 34 genes are involved in the processing and transport of multiple RNA species, such as mRNAs, snRNAs, rRNAs, and tRNAs (FIG. 2, Panel a). This result suggests that the transport of various RNA species is a critical cellular process required by cancers overexpressing MYC.

Next, whether the expression of these 34 genes involved in RNA transport is regulated by MYC was examined. First, in the RNA-seq data sets of primary liver tumors derived from the LAP-tTA/tet-O-MYC mouse model[16,29], MYC overexpression increased the transcript levels of these genes by 3-10 fold in liver tumors compared to normal liver tissues. Furthermore, upon the shutdown of MYC expression in liver tumors, the expression of these 34 genes significantly decreased within 16 hours to a level similar to that in normal liver tissues, suggesting that their expression is directly regulated by MYC activity (FIG. 2, Panel b). As a control, the expression of β-2 microglobulin (B2m) did not change significantly. Second, in the Eμ-MYC lymphoma model[30,31], a 2-7 fold steady increase in the expression of these genes was observed during the tumorigenesis from normal B cells to premalignant cancer cells, and then to overt lymphoma (FIG. 2, Panel c). Lastly, in the human Burkitt lymphoma-like P493-6 cell line with Tet-regulated MYC expression[32], MYC overexpression upregulates the expression of the RNA transport genes by 3-12 fold (FIG. 2, Panel d). Thus, our analysis across multiple cancer contexts showed that these MYC-SL genes involved in RNA transport are regulated by MYC during tumorigenesis.

Xpo1 Inhibition Blocks RNA Export in MYC Overexpressing Cancer

Amongst the MYC-SL RNA transport genes, Prmt5 and Xpo1 are currently druggable and Xpo1 inhibitors are in clinical trials for multiple myeloma[33-36]. Xpo1 is a transport receptor that forms a complex with the Ran GTPase and drives the transport of multiple RNA species as well as protein targets[37,38].

Whether Xpo1 inhibition can block RNA transportation in MYC-driven cancer cell lines was tested. KPT-330 is a highly selective small molecule chemical inhibitor of Xpo1 and a heterozygous point mutation of cysteine 528 in Xpo1 is sufficient to confer drug resistance to KPT-330[39-41]. Newly transcribed RNAs were labeled with a uridine analog 5-ethynyl uridine (EU) and detected the distribution of the labelled RNA in the cells with Click Chemistry[42]. The EC4 cancer cells treated with KPT-330 showed significantly reduced RNA distribution in the cytoplasm and increased RNA nuclear-cytoplasmic ratio, compared with the DMSO controls (FIG. 3, Panels a-b). In contrast, the staining of α-tubulin and cellular DNA content did not differ between the control and the cells treated with KPT-330. These data suggest that Xpo1 inhibition significantly blocks the export of total RNA in tumor cells overexpressing MYC.

Xpo1 is a Therapeutic Target in MYC-Overexpressing Cancer

Next, whether MYC-overexpressing cancer cells are more sensitive to Xpo1 inhibition as compared to the low MYC expressing cells was evaluated. The EC4 cells were treated under either MYC ON or MYC OFF states. It was found that the EC4 cells with MYC overexpression are highly sensitive to Xpo1 inhibition with a four-fold induction of tumor cell apoptosis upon KPT-330 treatment, while the EC4 cells with MYC OFF only have a modest increase in apoptosis (FIG. 4, Panel a). The half maximal inhibitory concentration (IC50) was further used to measure the sensitivity of KPT-330 in a panel of cell lines with high MYC expression (human Huh7, HepG2, and Hep40 liver cancer cell lines, human P493-6 Burkitt lymphoma-like cell line, a mouse MYC-driven T-cell acute lymphoblastic leukemia cell line, and an mouse IgH-MYC B-cell lymphoma cell line), liver cancer cell lines with low MYC expression (PLC/PRF/5, SNU-182, SNU-449)[10,47], as well as the normal human fibroblast BJ5-tA cell line. The normal fibroblast cell line and the liver cancer cell lines with low MYC expression are not sensitive to Xpo1 inhibition with IC50s ranging from 0.3 μM to >10 μM. In contrast, MYC overexpressing cancer cell lines are sensitive to KPT-330 with the IC50s in the range of 0.07 μM to 0.3 μM (FIG. 4, Panel b and FIG. 6, Panel a). In both EC4 and P493-6 cells, downregulation of MYC expression also shifted up the IC50 curve, indicating that the tumor cells are more resistant to Xpo1 inhibition under low MYC expression (FIG. 6, Panel b). Taken together, these data suggest that MYC overexpression is correlated with high sensitivity to Xpo1 inhibition.

It was further investigated whether Xpo1 inhibition can be an effective treatment for MYC-driven cancer in vivo. The therapeutic effect of Xpo1 inhibition was tested using primary liver tumors developed in the LAP-tTA/tet-O-MYC mouse model. MRI imagining was used to quantify the tumor volume both before and after KPT-330 treatment for two weeks. It was found that all the tumors drastically regressed upon Xpo1 inhibition with KPT-330 with a more than 95% reduction in tumor volume. In two mice with smaller tumors, complete tumor regression was observed according to the MRI scan (FIG. 4, Panels c-e and FIG. 7). In contrast, the tumor size increased 4-12 fold within the same two-week time frame in mice treated with vehicle control. To examine the mechanism of tumor regression, regressing tumors were isolated following a short-term Xpo1 inhibition, and tumor cell proliferation was studied by phospho-histone H3 staining and apoptosis by cleaved caspse-3 staining. Xpo1 inhibition completely suppressed the proliferation and significantly induced apoptosis in tumor cells (FIG. 4, Panels f-g). Further histological examination of tumor sections showed only sporadic tumor cells left in mice with Xpo1 inhibition (FIG. 4, Panel f and FIG. 8). No significant proliferation or apoptosis was observed in the adjacent liver tissues in mice with Xpo1 inhibition, indicating minimal toxicity to the normal hepatocytes. These data demonstrate that tumors overexpressing MYC, compared to normal liver tissues, are more sensitive to Xpo1 inhibition and that Xpo1 is a highly effective druggable target in vivo.

DISCUSSION

Through a genome-wide CRISPR library screen, synthetic lethal interactions of MYC were identified with the goal of finding therapeutic targets for MYC-overexpressing cancers. It was found that multiple aspects of RNA metabolism, including RNA transcription amplification, mRNA splicing, ribosomal biogenesis, RNA transport, and RNA degradation, are essential for MYC-overexpressing cancers. In addition to RNA metabolism, it was also found that DNA repair, pyrimidine metabolism, and terpenoid backbone synthesis are required by MYC-overexpressing tumors.

Notably, this study showed that RNA transport, which is the intermediate step between RNA production in the nucleus and RNA translation and/or degradation in the cytoplasm, is upregulated by MYC. MYC regulates the expression of many genes involved the transport or shuttling of various RNA species. This coordinated regulation of RNA transport by MYC may directly and indirectly promote the maturation and translation of mRNA and contribute to the maintenance of the cancer phenotype. Thus, these findings highlight RNA transport as a novel genetic vulnerability of MYC-driven cancers and provide a missing piece as to the role of RNA metabolism MYC-driven tumorigenesis. In particular, it is shown that, inhibition of Xpo1, a pivotal receptor in the RNA transport pathway, blocks RNA export, and exhibits marked in vivo therapeutic effects in cancers overexpressing MYC. Xpo1 as a therapeutic target specifically for the treatment of human cancers overexpressing MYC warrants future clinical trials.

REFERENCES

10 Huang, C. H. et al. CDK9-mediated transcription elongation is required for MYC addiction in hepatocellular carcinoma. *Genes & development* 28, 1800-1814, doi: 10.1101/gad.244368.114 (2014).
12 Hsu, T. Y. et al. The spliceosome is a therapeutic vulnerability in MYC-driven cancer. *Nature* 525, 384-388, doi:10.1038/nature14985 (2015).
13 Barna, M. et al. Suppression of Myc oncogenic activity by ribosomal protein haploinsufficiency. *Nature* 456, 971-975, doi:10.1038/nature07449 (2008).
14 Shalem, O. et al. Genome-scale CRISPR-Cas9 knockout screening in human cells. *Science* 343, 84-87, doi: 10.1126/science.1247005 (2014).
16 Shachaf, C. M. et al. MYC inactivation uncovers pluripotent differentiation and tumour dormancy in hepatocellular cancer. *Nature* 431, 1112-1117, doi:10.1038/nature03043 (2004).
22 Koh, C. M. et al. MYC regulates the core pre-mRNA splicing machinery as an essential step in lymphomagenesis. *Nature* 523, 96-100, doi:10.1038/nature14351 (2015).
24 Dang, C. V. MYC, metabolism, cell growth, and tumorigenesis. *Cold Spring Harbor perspectives in medicine* 3, doi:10.1101/cshperspect.a014217 (2013).
25 Nie, Z. et al. c-Myc is a universal amplifier of expressed genes in lymphocytes and embryonic stem cells. *Cell* 151, 68-79, doi:10.1016/j.cell.2012.08.033 (2012).
26 Lin, C. Y. et al. Transcriptional amplification in tumor cells with elevated c-Myc. *Cell* 151, 56-67, doi:10.1016/j.cell.2012.08.026 (2012).
27 Schlosser, 1. et al. A role for c-Myc in the regulation of ribosomal RNA processing. *Nucleic acids research* 31, 6148-6156 (2003).
28 Rounbehler, R. J. et al. Tristetraprolin impairs myc-induced lymphoma and abolishes the malignant state. *Cell* 150, 563-574, doi:10.1016/j.cell.2012.06.033 (2012).
29 Kress, T. R. et al. Identification of MYC-Dependent Transcriptional Programs in Oncogene-Addicted Liver Tumors. *Cancer research* 76, 3463-3472, doi:10.1158/0008-5472.CAN-16-0316 (2016).
30 Adams, J. M. et al. The c-myc oncogene driven by immunoglobulin enhancers induces lymphoid malignancy in transgenic mice. *Nature* 318, 533-538 (1985).
31 Sabo, A. et al. Selective transcriptional regulation by Myc in cellular growth control and lymphomagenesis. *Nature* 511, 488-492, doi:10.1038/nature13537 (2014).
32 Schuhmacher, M. et al. Control of cell growth by c-Myc in the absence of cell division. *Current biology: CB* 9, 1255-1258 (1999).
33 Chan-Penebre, E. et al. A selective inhibitor of PRMT5 with in vivo and in vitro potency in MCL models. *Nature chemical biology* 11, 432-437, doi:10.1038/nchembio.1810 (2015).
34 Alinari, L. et al. Selective inhibition of protein arginine methyltransferase 5 blocks initiation and maintenance of B-cell transformation. *Blood* 125, 2530-2543, doi: 10.1182/blood-2014-12-619783 (2015).
35 Conforti, F. et al. Molecular Pathways: Anticancer Activity by Inhibition of Nucleocytoplasmic Shuttling. *Clinical cancer research: an official journal of the American Association for Cancer Research* 21, 4508-4513, doi: 10.1158/1078-0432.CCR-15-0408 (2015).
36 Crochiere, M. et al. Deciphering mechanisms of drug sensitivity and resistance to Selective Inhibitor of Nuclear Export (SINE) compounds. *BMC cancer* 15, 910, doi: 10.1186/s12885-015-1790-z (2015).
37 Hutten, S. & Kehlenbach, R. H. CRM1-mediated nuclear export: to the pore and beyond. *Trends in cell biology* 17, 193-201, doi:10.1016/j.tcb.2007.02.003 (2007).
38 Delaleau, M. & Borden, K. L. Multiple Export Mechanisms for mRNAs. *Cells* 4, 452-473, doi:10.3390/cells4030452 (2015).
39 Neggers, J. E. et al. Identifying drug-target selectivity of small-molecule CRM1/XPO1 inhibitors by CRISPR/Cas9 genome editing. *Chemistry & biology* 22, 107-116, doi:10.1016/j.chembiol.2014.11.015 (2015).
40 Neggers, J. E. et al. Heterozygous mutation of cysteine 528 in XPO1 is sufficient for resistance to selective inhibitors of nuclear export. *Oncotarget*, doi:10.18632/oncotarget.11995 (2016).
41 Kim, J. et al. XPO1-dependent nuclear export is a druggable vulnerability in KRAS-mutant lung cancer. *Nature* 538, 114-117, doi:10.1038/nature19771 (2016).
42 Jao, C. Y. & Salic, A. Exploring RNA transcription and turnover in vivo by using click chemistry. *Proceedings of the National Academy of Sciences of the United States of America* 105, 15779-15784, doi:10.1073/pnas.0808480105 (2008).

43 Sandhu, D. S., Baichoo, E. & Roberts, L. R. Fibroblast growth factor signaling in liver carcinogenesis. *Hepatology* 59, 1166-1173 (2014).

44 Geisler, F. & Strazzabosco, M. Emerging roles of Notch signaling in liver disease. *Hepatology* 61, 382-392, doi: 10.1002/hep.27268 (2015).

45 Villanueva, A. et al. Notch signaling is activated in human hepatocellular carcinoma and induces tumor formation in mice. *Gastroenterology* 143, 1660-1669 e1667, doi:10.1053/j.gastro.2012.09.002 (2012).

46 Pez, F. et al. Wnt signaling and hepatocarcinogenesis: molecular targets for the development of innovative anticancer drugs. *Journal of hepatology* 59, 1107-1117, doi: 10.1016/j.jhep.2013.07.001 (2013).

47 Iliopoulos, D., Satra, M., Drakaki, A., Poultsides, G. A. & Tsezou, A. Epigenetic regulation of hTERT promoter in hepatocellular carcinomas. *International journal of oncology* 34, 391-399 (2009).

The preceding merely illustrates the principles of the invention. It will be appreciated that those skilled in the art will be able to devise various arrangements which, although not explicitly described or shown herein, embody the principles of the invention and are included within its spirit and scope. Furthermore, all examples and conditional language recited herein are principally intended to aid the reader in understanding the principles of the invention and the concepts contributed by the inventors to furthering the art, and are to be construed as being without limitation to such specifically recited examples and conditions. Moreover, all statements herein reciting principles, aspects, and embodiments of the invention as well as specific examples thereof, are intended to encompass both structural and functional equivalents thereof. Additionally, it is intended that such equivalents include both currently known equivalents and equivalents developed in the future, i.e., any elements developed that perform the same function, regardless of structure. The scope of the present invention, therefore, is not intended to be limited to the exemplary embodiments shown and described herein. Rather, the scope and spirit of the present invention is embodied by the appended claims.

SEQUENCE LISTING (259 sequences)

SEQ ID NO: 1 - DNA, 20 bp, Artificial sequence
  synthetic polynucleotide sequence
gcgtgcagtttagggcatcg

SEQ ID NO: 2 - DNA, 20 bp, Artificial sequence
  synthetic polynucleotide sequence
ggccagaaatgatccggact

SEQ ID NO: 3 - protein, 968 aa, Homo sapiens
MDSTLTASEIRQRFIDFFKRNEHTYVHSSATIPLDDPTLLFANAGMNQFKPIFLNTIDPSHPMAKLSRAANTQKCIRAGGKHNDLDDVGKDVYHHTFFEMLGSWSFGDYFKELACKMALELLTQEFGIPIERLYVTYFGGDEAAGLEADLECKQIWQNLGLDDTKILPGNMKDNFWEMGDTGPCGPCSEIHYDRIGGRDAAHLVNQDDPNVLEIWNLVFIQYNREADGILKPLPKKSIDTGMGLERLVSVLQNKMSNYDTDLFVPYFEAIQKGTGARPYTGKVGAEDADGIDMAYRVLADHARTITVALADGGRPDNTGRGYVLRRILRRAVRYAHEKLNASRGFFATLVDVVVQSLGDAFPELKKDPDMVKDIINEEEVQFLKTLSRGRRILDRKIQSLGDSKTIPGDTAWLLYDTYGFPVDLTGLIAEEKGLVVDMDGFEEERKLAQLKSQGKGAGGEDLIMLDIYAIEELRARGLEVTDDSPKYNYHLDSSGSYVFENTVATVMALRREKMFVEEVSTGQECGVVLDKTCFYAEQGGQIYDEGYLVKVDDSSEDKTEFTVKNAQVRGGYVLHIGTIYGDLKVGDQVWLFIDEPRRRPIMSNHTATHILNFALRSVLGEADQKGSLVAPDRLRFDFTAKGAMSTQQIKKAEEIANEMIEAAKAVYTQDCPLAAAKAIQGLRAVFDETYPDPVRVVSIGVPVSELLDDPSGPAGSLTSVEFCGGTHLRNSSHAGAFVIVTEEAIAKGIRRIVAVTGAEAQKALRKAESLKKCLSVMEAKVKAQTAPNKDVQREIADLGEALATAVIPQWQKDELRETLKSLKKVMDDLDRASKADVQKRVLEKTKQFIDSNPNQPLVILEMESGASAKALNEALKLFKMHSPQTSAMLFTVDNEAGKITCLCQVPQNAANRGLKASEWVQQVSGLMDGKGGGKDVSAQATGKNVGCLQEALQLATSFAQLRLGDVKN

SEQ ID NO: 4 - protein, 985 aa, Homo sapiens
MAASVAAAARRLRRAIRRSPAWRGLSHRPLSSEPPAAKASAVRAAFLNFFRDRHGHRLVPSASVRPRGDPSLLFVNAGMNQFKPIFLGTVDPRSEMAGFRRVANSQKCVRAGGHHNDLEDVGRDLSHHTFFEMLGNWAFGGEYFKEEACNMAWELLTQVYGIPEERLWISYFDGDPKAGLDPDLETRDIWLSLGVPASRVLSFGPQENFWEMGDTGPCGPCTEIHYDLAGGVGAPQLVELWNLVFMQHNREADGSLQPLPQRHVDTGMGLERLVAVLQGKHSTYDTDLFSPLLNAIQQGCRAPPYLGRVGVADEGRTDTAYRVVADHIRTLSVCISDGIFPGMSGPPLVLRRILRRAVRFSMEILKAPPGFLGSLVPVVVETLGDAYPELQRNSAQIANLVSEDEAAFLASLERGRRIIDRTLRTLGPSDMFPAEVAWSLSLCGDLGLPLDMVELMLEEKGVQLDSAGLERLAQEEAQHRARQAEPVQKQGLWLDVHALGELQRQGVPPTDDSPKYNYSLRPSGSYEFGTCEAQVLQLYTEDGTAVASVGKGQRCGLLLDRTNFYAEQGGQASDRGYLVRAGQEDVLFPVARAQVCGGFILHEAVAPECLRLGDQVQLHVDEAWRLGCMAKHTATHLLNWALRQTLGPGTEQQGSHLNPEQLRLDVTTQTPLTPEQLRAVENTVQEAVGQDEAVYMEEVPLALTAQVPGLRSLDEVYPDPVRVVSVGVPVAHALDPASQAALQTSVELCCGTHLLRTGAVGDLVIIGDRQLSKGTTRLLAVTGEQAQQARELGQSLAQEVKAATERLSLGSRDVAEALRLSKDIGRLIEAVETAVMPQWQRRELLATVKMLQRRANTAIRKLQMGQAAKKTQELLERHSKGPLIVDTVSAESLSVLVKVVRQLCEQAPSTSVLLLSPQPMGKVLCACQVAQGAMPTFTAEAWALAVCSHMGGKAWGSRVVAQGTGSTTDLEAALSIAQTYALSQL

SEQ ID NO: 5 - protein, 780 aa, Homo sapiens
MAPYSLLVTRLQKALGVRQYHVASVLCQRAKVAMSHFEPNEYIHYDLLEKNINIVRKRLNRPLTLSEKIVYGHLDDPASQEIERGKSYLRLRPDRVAMQDATAQMAMLQFISSGLSKVAVPSTIHCDHLIEAQVGGEKDLRRAKDINQEVYNFLATAGAKYGVGFWKPGSGIIHQIILENYAYPGVLLIGTDSHTPNGGGLGGICIGVGGADAVDVMAGIPWELKCPKVIGVKLTGSLSGWSSPKDVILKVAGILTVKGGTGAIVEYHGPGVDSISCTGMATICNMGAEIGATTSVFPYNHRMKKYLSKTGREDIANLADEFKDHLVPDPGCHYDQLIEINLSELKPHINGPFTPDLAHPVAEVGKVAEKEGWPLDIRVGLIGSCTNSSYEDMGRSAAVAKQALAHGLKCKSQFTITPGSEQIRATIERDGYAQILRDLGGIVLANACGPCIGQWDRKDIKKGEKNTIVTSYNRNFTGRNDANPETHAFVTSPEIVTALAIAGTLKFNPETDYLTGTDGKKFRLEAPDADELPKGEFDPGQDTYQHPPKDSSGQHVDVSPTSQRLQLLEPFDKWDGKDLEDLQILIKVKGKCTTDHISAAGPWLKFRGHLDNISNNLLIGAINIENGKANSVRNAVTQEFGPVPDTARYYKKHGIRWVVIGDENYGEGSSREHAALEPRHLGGRAIITKSFARIHETNLKKQGLLPLTFADPADYNKIHPVDKLTIQGLKDFTPGKPLKCIIKHPNGTQETILLNHTFNETQIEWFRAGSALNRMKELQQ

SEQ ID NO: 6 - protein, 185 aa, Homo sapiens
MKLVSVALMYLGSLAFLGADTARLDVASEFRKKWNKWALSRGKRELRMSSSYPTGLADVKAGPAQTLIRPQDMKGASRSPEDSSPDAARIRVKRYRQSMNNFQGLRSFGCRFGTCTVQKLAHQIYQFTDKDKDNVAPRSKISPQGYGRRRRRSLPEAGPGRTLVSSKPQAHGAPAPPSGSAPHFL

SEQ ID NO: 7 - protein, 848 aa, Homo sapiens
MNSSSANITYASRKRRKPVQKTVKPIPAEGIKSNPSKRHRDRLNTELDRLASLLPFPQDVINKLDKLSVLRLSVSYLRAKSFFDVALKSSPTERNGGQDNCRAANFREGLNLQEGEFLLQALNGFVLVVTTDALVFYASSTIQDYLGFQQSDVIHQSVYELIHTEDRAEFQRQLHWALNPSQCTESGQGIEEATGLPQTVVCYNPDQIPPENSPLMERCFICRLRCLLDNSSGFLAMNFQGKLKYLHGQKKKGKDGSILPPQLALFAIATPLQPPSILEIRTKNFIFRTKHKLDFTPIGCDAKGRIVLGYTEAELCTRGSGYQFIHAADMLYCAESHIRMIKTGESGMIVFRLLTKNNRWTWVQSNARLLYKNGRPDYIIVTQRPLTDEEGTEHLRKRNTKLPFMFTTGEAVLYEATNPFPAIMDPLPLRTKNGTSGKDSATTSTLSKDSLNPSSLLAAMMQQDESIYLYPASSTSSTAPFENNFFNESMNECRNWQDNTAPMGNDTILKHEQIDQPQDVNSFAGGHPGLFQDSKNSDLYSIMKNLGIDFEDIRHMQNEKFFRNDFSGEVDFRDIDLTDEILTYVQDSLSKSPFIPSDYQQQQSLALNSSCMVQEHLHLEQQQQHHQKQVVVEPQQQLCQKMKHMQVNGMFENWNSNQFVPFNCPQQDPQQYNVFTDLHGISQEFPYKSEMDSMPYTQNFISCNQPVLPQHSKCTELDYPMGSFEPSPYPTTSSLEDFVTCLQLPENQKHGLNPQSAIITPQTCYAGAVSMYQCQPEPQHTHVGQMQYNPVLPGQQAFLNKFQNGVLNETYPAELNNINNTQTTTHLQPLHHPSEARPFPDLTSSGFL

SEQ ID NO: 8 - protein, 364 aa, Homo sapiens
MPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 9 - protein, 168 aa, Homo sapiens
MTATLRPYLSAVRATLQAALCLENFSSQVVERHNKPEVEVRSSKELLLQPVTISRNEKEKVLIEGSINSVRVSIAVKQADEIEKILCHKFMRFMMMRAENFFILRRKPVEGYDISFLITNFHTEQMYKHKLVDFVIHFMEEIDKEISEMKLSVNARARIVAEEFLKNF

SEQ ID NO: 10 - protein, 553 aa, Homo sapiens
MLSVRVAAAVVRALPRRAGLVSRNALGSSFIAARNFHASNTHLQKTGTAEMSSILEERILGADTSVDLEETGRVLSIGDGIARVHGLRNVQAEEMVEFSSGLKGMSLNLEPDNVGVVVFGNDKLIKEGDIVKRTGAIVDVPVGEELLGRVVDALGNAIDGKGPIGSKTRRRVGLKAPGIIPRISVREPMQTGIKAVDSLVPIGRGQRELIIGDRQTGKTSIAIDTIINQKRFNDGSDEKKKLYCIYVAIGQKRSTVAQLVKRLTDADAMKYTIVVSATASDAAPLQYLAPYSGCSMGEYFRDNGKHALIIYDDLSKQAVAYRQMSLLLRRPPGREAYPGDVFYLHSRLLERAAKMNDAFGGGSLTALPVIETQAGDVSAYIPTNVISITDGQIFLETELFYKGIRPAINVGLSVSRVGSAAQTRAMKQVAGTMKLELAQYREVAAFAQFGSDLDAATQQLLSRGVRLTELLKQGQYSPMAIEEQVAVIYAGVRGYLDKLEPSKITKFENAFLSHVVSQHQALLGTIRADGKISEQSDAKLKEIVTNFLAGFEA

SEQ ID NO: 11 - protein, 529 aa, Homo sapiens
MLGFVGRVAAAPASGALRRLTPSASLPPAQLLLRAAPTAVHPVRDYAAQTSPSPKAGAATGRIVAVIGAVVDVQFDEGLPPILNALEVQGRETRLVLEVAQHLGESTVRTIAMDGTEGLVRGQKVLDSGAPIKIPVGPETLGRIMNVIGEPIDERGPIKTKQFAPIHAEAPEFMEMSVEQEILVTGIKVVDLLAPYAKGGKIGLFGGAGVGKTVLIMELINNVAKAHGGYSVFAGVGERTREGNDLYHEMIESGVINLKDATSKVALVYGQMNEPPGARARVALTGLTVAEYFRDQEGQDVLLFIDNIFRFTQAGSEVSALLGRIPSAVGYQPTLATDMGTMQERITTTKKGSITSVQAIYVPADDLTDPAPATTFAHLDATTVLSRAIAELGIYPAVDPLDSTSRIMDPNIVGSEHYDVARGVQKILQDYKSLQDIIAILGMDELSEEDKLTVSRARKIQRFLSQPFQVAEVFTGHMGKLVPLKETIKGFQQILAGEYDHLPEQAFYMVGPIEEAVAKADKLAEEHSS

SEQ ID NO: 12 - protein, 617 aa, Homo sapiens
MDFSKLPKILDEDKESTFGYVHGVSGPVVTACDMAGAAMYELVRVGHSELVGEIIRLEGDMATIQVYEETSGVSVGDPVLRTGKPLSVELGPGIMGAIFDGIQRPLSDISSQTQSIYIPRGVNVSALSRDIKWDFTPCKNLRVGSHITGGDIYGIVSENSLIKHKIMLPPRNRGTVTYIAPPGNYDTSDVVLELEFEGVKEKFTMVQVWPVRQVRPVTEKLPANHPLLTGQRVLDALFPCVQGGTTAIPGAFGCGKTVISQSLSKYSNSDVIIYVGCGERGNEMSEVLRDFPELTMEVDGKVESIMKRTALVANTSNMPVAAREASIYTGITLSEYFRDMGYHVSMMADSTSRWAEALREISGRLAEMPADSGYPAYLGARLASFYERAGRVKCLGNPEREGSVSIVGAVSPPGGDFSDPVTSATLGIVQVFWGLDKKLAQRKHFPSVNWLISYSKYMRALDEYYDKHFTEFVPLRTKAKEILQEEEDLAEIVQLVGKASLAETDKITLEVAKLIKDDFLQQNGYTPYDRFCPFYKTVGMLSNMIAFYDMARRAVETTAQSDNKITWSIIREHMGDILYKLSSMKFKDPLKDGEAKIKSDYAQLLEDMQNAFRSLED

SEQ ID NO: 13 - protein, 1164 aa, Homo sapiens
MPTMRRTVSEIRSRAEGYEKTDDVSEKTSLADQEEVRTIFINQPQLTKFCNNHVSTAKYNIITFLPRFLYSQFRRAANSFFLFIALLQQIPDVSPTGRYTTLVPLLFILAVAAIKEIIEDIKRHKADNAVNKKQTQVLRNGAWEIVHWEKVAVGEIVKVTNGEHLPADLISLSSSEPQAMCYIETSNLDGETNLKIRQGLPATSDIKDVDSLMRISGRIECESPNRHLYDFVGNIRLDGHGTVPLGADQILLRGAQLRNTQWVHGIVVYTGHDTKLMQNSTSPPLKLSNVERITNVQILILFCILIAMSLVCSVGSAIWNRRHSGKDWYLNLNYGGASNFGLNFLTFIILFNNLIPISLLVTLEVVKFTQAYFINWDLDMHYEPTDTAAMARTSNLNEELGQVKYIFSDKTGTLTCNVMQFKKCTIAGVAYGHVPEPEDYGCSPDEWQNSQFGDEKTFSDSSLLENLQNNHPTAPIICEFLTMMAVCHTAVPEREGDKIIYQAASPDEGALVRAAKQLNFVFTGRTPDSVIIDSLGQEERYELLNVLEFTSARKRMSVIVRTPSGKLRLYCKGADTVIYDRLAETSKYKEITLKHLEQFATEGLRTLCFAVAEISESDFQEWRAVYQRASTSVQNRLLKLEESYELIEKNLQLLGATAIEDKLQDQVPETIETLMKADIKIWILTGDKQETAINIGHSCKLLKKNMGMIVINEGSLDGTRETLSRHCTTLGDALRKENDFALIIDGKTLKYALTFGVRQYFLDLALSCKAVICCRVSPLQKSEVVEMVKKQVKVVTLAIGDGANDVSMIQTAHVGVGISGNEGLQAANSSDYSIAQFKYLKNLLMIHGAWNYNRVSKCILYCFYKNIVLYIIEIWFAFVNGFSGQILFERWCIGLYNVMFTAMPPLTLGIFERSCRKENMLKYPELYKTSQNALDFNTKVFWVHCLNGLFHSVILFWFPLKALQYGTAFGNGKTSDYLLLGNFVYTFVVITVCLKAGLETSYWTWFSHIAIWGSIALWVVFFGIYSSLWPAIPMAPDMSGEAAMLFSSGVFWMGLLFIPVASLLLDVVYKVIKRTAFKTLVDEVQELEAKSQDPGAVVLGKSLTERAQLLKNVFKKNHVNLYRSESLQQNLLHGYAFSQDENGIVSQSEVIRAYDTTKQRPDEW

SEQ ID NO: 14 - protein, 2644 aa, Homo sapiens
MGEHGLELASMIPALRELGSATPEEYNTVVQKPRQILCQFIDRILTDVNVVAVELVKKTDSQPTSVMLLDFIQHIMKSSPLMFVNVSGSHEAKGSCIEFSNWIITRLLRIAATPSCHLLHKKICEVICSLLFLFKSKSPAIFGVLTKELLQLFEDLVYLHRRNVMGHAVEWPVVMSRFLSQLDEHMGYLQSAPLQLMSMQNLEFIEVTLLMVLTRIIAIVFFRRQELLLWQIGCVLLEYGSPKIKSLAISFLTELFQLGGLPAQPASTFFSSFLELLKHLVEMDTDQLKLYEEPLSKLIKTLFPFEAEAYRNIEPVYLNMLLEKLCVMFEDGVLMRLKSDLLKAALCHLLQYFLKFVPAGYESALQVRKVYVRNICKALLDVLGIEVDAEYLLGPLYAALKMESMEIIEEIQCQTQQENLSSNSDGISPKRRRLSSSLNPSKRAPKQTEEIKHVDMNQKSILWSALKQKAESLQISLEYSGLKNPVIEMLEGIAVVLQLTALCTVHCSHQNMNCRTFKDCQHKSKKKPSVVITWMSLDFYTKVLKSCRSLLESVQKLDLEATIDKVVKIYDALIYMQVNSSFEDHILEDLCGMLSLPWIYSHSDDGCLKLTTFAANLLTLSCRISDSYSPQAQSRCVFLLTLFPRRIFLEWRTAVYNWALQSSHEVIRASCVSGFFILLQQQNSCNRVPKILIDKVKDDSDIVKKEFASILGQLVCTLHGMFYLTSSLTEPFSEHGHVDLFCRNLKATSQHECSSSQLKASVCKPFLFLLKKKIPSPVKLAFIDNLHHLCKHLDFREDETDVKAVLGTLLNLMEDPDKDVRVAFSGNIKHILESLDSEDGFIKELFVLRMKEAYTHAQISRNNELKDTLILTTGDIGRAAKGDLVPFALLHLLHCLLSKSASVSGAAYTEIRALVAAKSVKLQSFFSQYKKPICQFLVESLHSSQMTALPNTPCQNADVRKQDVAHQREMALNTLSEIANVFDFPDLNRFLTRTLQVLLPDLAAKASPAASALIRTLGKQLNVNRREILINNFKYIFSHLVCSCSKDELERALHYLKNETEIELGSLLRQDFQGLHNELLLRIGEHYQQVFNGLSILASFASSDDPYQGPRDIISPELMADYLQPKLLGILAFFNMQLLSSSVGIEDKKMALNSLMSLMKLMGPKHVSSVRVKMMTTLRTGLRFKDDFPELCCRAWDCFVRCLDHACLGSLLSHVIVALLPLIHIQPKETAAIFHYLIIENRDAVQDFLHEIYFLPDHPELKKIKAVLQEYRKETSESTDLQTTLQLSMKAIQHENVDVRIHALTSLKETLYKNQEKLIKYATDSETVEPIISQLVTVLLKGCQDANSQARLLCGECLGELGAIDPGRLDFSTTETQGKDFTFVTGVEDSSFAYGLLMELTRAYLAYADNSRAQDSAAYAIQELLSIYDCREMETNGPGHQLWRRFPEHVREILEPHLNTRYKSSQKSTDWSGVKKPIYLSKLGSNFAEWSASWAGYLITKVRHDLASKIFTCCSIMMKHDFKVTIYLLPHILVYVLLGCNQEDQQEVYAEIMAVLKHDDQHTINTQDIASDLCQLSTQTVFSMLDHLTQWARHKFQALKAEKCPHSKSNRNKVDSMVSTVDYEDYQSVTRFLDLIPQDTLAVASFRSKAYTRAVMHFESFITEKKQNIQEHLGFLQKLYAAMHEPDGVAGVSAIRKAEPSLKEQILEHESLGLLRDATACYDRAIQLEPDQIIHYHGVVKSMLGLGQLSTVITQVNGVHANRSEWTDELNTYRVEAAWKLSQWDLVENYLAADGKSTTWSVRLGQLLLSAKKRDITAFYDSLKLVRAEQIVPLSAASFERGSYQRGYEYIVRLHMLCELEHSIKPLFQHSPGDSSQEDSLNWVARLEMTQNSYRAKEPILALRRALLSLNKRPDYNEMVGECWLQSARVARKAGHHQTAYNALLNAGESRLAELYVERAKWLWSKGDVHQALIVLQKGVELCFPENETPPEGKNMLIHGRAMLLVGRFMEETANFESNAIMKKYKDVTACLPEWEDGHFYLAKYYDKLMPMVTDNKMEKQGDLIRYIVLHFGRSLQYGNQFIYQSMPRMLTLWLDYGTKAYEWEKAGRSDRVQMRNDLGKINKVITEHTNYLAPYQFLTAFSQLISRICHSHDEVFVVLMEIIAKVFLAYPQQAMWMMTAVSKSSYPMRVNRCKEILNKAIHMKKSLEKFVGDATRLTDKLLELCNKPVDGSSSTLSMSTHFKMLKKLVEEATFSEILIPLQSVMIPTLPSILGTHANHASHEPFPGHWAYIAGFDDMVEILASLQKPKKISLKGSDGKFYIMMCKPKDDLRKDCRLMEFNSLINKCLRKDAESRRRELHIRTYAVIPLNDECGIIEWVNNTAGLRPILTKLYKEKGVYMTGKELRQCMLPKSAALSEKLKVFREFLLPRHPPIFHEWFLRTFPDPTSWYSSRSAYCRSTAVMSMVGYILGLGDRHGENILFDSLTGECVHVDFNCLFNKGETFEVPEIVPFRLTHNMVNGMGPMGTEGLFRRACEVTMRLMRDQREPLMSVLKTFLHDPLVEWSKPVKGHSKAPLNETGEVVNEKAKTHVLDIEQRLQGVIKTRNRVTGLPLSIEGHVHYLIQEATDENLLCQMYLGWTPYM

SEQ ID NO: 15 - protein, 403 aa, Homo sapiens [sequence omitted]

SEQ ID NO: 16 - protein, 142 aa, Homo sapiens
MGAPTLPPAWQPFLKDHRISTFKNWPFLEGCACTPERMAEAGFIHCPTENEPDLAQCFFCFKELEGWEPDDDPIEEHKKHSSGCAFLSVKKQFEELTLGEFLKLDRERAKNKIAKETNNKKKEFEETAKKVRRAIEQLAAMD

SEQ ID NO: 17 - protein, 1362 aa, Homo sapiens
MSAESGPGTRLRNLPVMGDGLETSQMSTTQAQAQPQPANAASTNPPPPETSNPNKPKRQTNQLQYLLRVVLKTLWKHQFAWPFQQPVDAVKLNLPDYYKIIKTPMDMGTIKKRLENNYYWNAQECIQDFNTMFTNCYIYNKPGDDIVLMAEALEKLFLQKINELPTEETEIMIVQAKGRGRGRKETGTAKPGVSTVPNTTQASTPPQTQTPQPNPPPVQATPHPFPAVTPDLIVQTPVMTVVPPQPLQTPPPVPPQPQPPPAPAPQPVQSHPPIIAATPQPVKTKKGVKRKADTTTPTTIDPIHEPPSLPPEPKTTKLGQRRESSRPVKPPKKDVPDSQQHPAPEKSSKVSEQLKCCSGILKEMFAKKHAAYAWPFYKPVDVEALGLHDYCDIIKHPMDMSTIKSKLEAREYRDAQEFGADVRLMFSNCYKYNPPDHEVVAMARKLQDVFEMRFAKMPDEPEEPVVAVSSPAVPPPTKVVAPPSSSDSSSDSSSDSDSSTDDSEEERAQRLAELQEQLKAVHEQLAALSQPQQNKPKKKEKDKKEKKKEKHKRKEEVEENKKSKAKEPPPKKTKKNNSSNSNVSKKEPAPMKSKPPPTYESEEEDKCKPMSYEEKRQLSLDINKLPGEKLGRVVHIIQSREPSLKNSNPDEIEIDFETLKPSTLRELERYVTSCLRKKRKPQAEKVDVIAGSSKMKGFSSSESESSSESSSSDSEDSETEMAPKSKKKGHPGREQKKHHHHHHQQMQQAPAPVPQQPPPPPQQPPPPPPPQQQQQPPPPPPPPSMPQQAAPAMKSSPPPFIATQVPVLEPQLPGSVFDPIGHFTQPILHLPQPELPPHLPQPPEHSTPPHLNQHAVVSPPALHNALPQQPSRPSNRAAALPPKPARPPAVSPALTQTPLLPQPPMAQPPQVLLEDEEPPAPPLTSMQMQLYLQQLQKVQPPTPLLPSVKVQSQPPPPLPPPPHPSVQQQLQQQPPPPPPPQPQPPPQQQHQPPPRPVHLQPMQFSTHIQQPPPPQGQQPPHPPPGQQPPPPQPAKPQQVIQHHHSPRHHKSDPYSTGHLREAPSPLMIHSPQMSQFQSLTHQSPPQQNVQPKKQELRAASVVQPQPLVVVKEEKIHSPIIRSEPFSPSLRPEPPKHPESIKAPVHLPQRPEMKPVDVGRPVIRPPEQNAPPPGAPDKDKQKQEPKTPVAPKKDLKIKNMGSWASLVQKHPTTPSSTAKSSSDSFEQFRRAAREKEEREKALKAQAEHAEKEKERLRQERMRSREDEDALEQARRAHEEARRRQEQQQQQRQEQQQQQQQQAAAVAAAATPQAQSSQPQSMLDQQRELARKREQERRRREAMAATIDMNFQSDLLSIFEENLF

SEQ ID NO: 18 - protein, 484 aa, Homo sapiens
MYDDSYVPGFEDSEAGSADSYTSRPSLDSDVSLEEDRESARREVESQAQQQLERAKHKPVAFAVRTNVSYCGVLDEECPVQGSGVNFEAKDFLHIKEKYSNDWWIGRLVKEGGDIAFIPSPQRLESIRLKQEQKARRSGNPSSLSDIGNRRSPPPSLAKQKQKQAEHVPPYDVVPSMRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 19 - protein, 2225 aa, Homo sapiens
MAALVLEDGSVLRGQPFGAAVSTAGEVVFQTGMVGYPEALTDPSYKAQILVLTYPLIGNYGIPPDEMDEFGLCKWFESSGIHVAALVVGECCPTPSHWSATRTLHEWLQQHGIPGLQGVDTRELTKKLREQGSLLGKLVQNGTEPSSLPFLDPNARPLVPEVSIKTPRVFNTGGAPRILALDCGLKYNQIRCLCQRGAEVTVVPWDHALDSQEYEGLFLSNGPGDPASYPSVVSTLSRVLSEPNPRPVFGICLGHQLLALAIGAKTYKMRYGNRGHNQPCLLVGSGRCFLTSQNHGFAVETDSLPADWAPLFTNANDGSNEGIVHNSLPFFSVQFHPEHQAGPSDMELLFDIFLETVKEATAGNPGGQTVRERLTERLCPPGIPTPGSGLPPPRKVLILGSGGLSIGQAGEFDYSGSQAIKALKEENIQTLLINPNIATVQTSQGLADKVYFLPITPHYVTQVIRNERPDGVLLTFGGQTALNCGVELTKAGVLARYGVRVLGTPVETIELTEDRRAFAARMAEIGEHVAPSEAANSLEQAQAAAERLGYPVLVRAAFALGGLGSGFASNREELSALVAPAFAHTSQVLVDKSLKGWKEIEYEVVRDAYGNCVTVCNMENLDPLGIHTGESIVVAPSQTLNDREYQLLRQTAIKVTQHLGIVGECNVQYALNPESEQYYIIEVNARLSRSSALASKATGYPLAYVAAKLALGIPLPELRNSVTGGTAAFEPSVDYCVVKIPRWDLSKFLRVSTKIGSCMKSVGEVMGIGRSFEEAFQKALRMVDENCVGFDHTVKPVSDMELETPTDKRIFVVAAALWAGYSVDRLYELTRIDRWFLHRMKRIIAHAQLLEQHRGQPLPPDLLQQAKCLGFSDKQIALAVLSTELAVRKLRQELGICPAVKQIDTVAAEWPAQTNYLYLTYWGTTHDLTFRTPHVLVLGSGVYRIGSSVEFDWCAVGCIQQLRKMGYKTIMVNYNPETVSTDYDMCDRLYFDEISFEVVMDIYELENPEGVILSMGGQLPNNMAMALHRQQCRVLGTSPEAIDSAENRFKFSRLLDTIGISQPQWRELSDLESARQFCQTVGYPCVVRPSYVLSGAAMNVAYTDGDLERFLSSAAAVSKEHPVVISKFIQEAKEIDVDAVASDGVVAAIAISEHVENAGVHSGDATLVTPPQDITAKTLERIKAIVHAVGQELQVTGPFNLQLIAKDDQLKVIECNVRVSRSFPFVSKTLGVDLVALATRVIMGEEVEPVGLMTGSGVVGVKVPQFSFSRLAGADVVLGVEMTSTGEVAGFGESRCEAYLKAMLSTGFKIPKKNILLTIGSYKNKSELLPTVRLLESLGYSLYASLGTADFYTEHGVKVTAVDWHFEEAVDGECPPQRSILEQLAEKNFELVINLSMRGAGGRRLSSFVTKGYRTRRLAADFSVPLIIDIKCTKLFVEALGQIGPAPPLKVHVDCMTSQKLVRLPGLIDVHVHLREPGGTHKEDFASGTAAALAGGITMVCAMPNTRPPIIDAPALALAQKLAEAGARCDFALFLGASSENAGTLGTVAGSAAGLKLYLNETFSELRLDSVVQWMEHFETWPSHLPIVAHAEQQTVAAVLMVAQLTQRSVHICHVARKEEILLIKAAKARGLPVTCEVAPHHLFLSHDDLERLGPGKGEVRPELGSRQDVEALWENMAVIDCFASDHAPHTLEEKCGSRPPPGFPGLETMLPLLLTAVSEGRLSLDDLLQRLHHNPRRIFHLPPQEDTYVEVDLEHEWTIPSHMPFSKAHWTPFEGQKVKGTVRRVVLRGEVAYIDGQVLVPPGYGQDVRKWPQGAVPQLPPSAPATSEMTTTPERPRRGIPGLPDGRFHLPPRIHRASDPGLPAEEPKEKSSRKVAEPELMGTPDGTCYPPPPVPRQASPQNLGTPGLLHPQTSPLLHSLVGQHILSVQQFTKDQMSHLFNVAHTLRMMVQKERSLDILKGKVMASMFYEVSTRTSSSFAAAMARLGGAVLSFSEATSSVQKGESLADSVQTMSCYADVVVLRHPQPGAVELAAKHCRRPVINAGDGVGEHPTQALLDIFTIREELGTVNGMTITMVGDLKHGRTVHSLACLLTQYRVSLRYVAPPSLRMPPTVRAFVASRGTKQEEFESIEEALPDTDVLYMTRIQKERFGSTQEYEACFGQFILTPHIMTRAKKKMVVMHPMPRVNEISVEVDSDPRAAYFRQAENGMYIRMALLATVLGRF

SEQ ID NO: 20 - protein, 432 aa, Homo sapiens
MLGNSAPGPATREAGSALLALQQTALQEDQENINPEKAAPVQQPRTRAALAVLKSGNPRGLAQQQRPKTRRVAPLKDLPVNDEHVTVPPWKANSKQPAFTIHVDEAEKEAQKKPAESQKIEREDALAFNSAISLPGPRKPLVPLDYPMDGSFESPHTMDMSIILEDEKPVSVNEVPDYHEDIHTYLREMEVKCKPKVGYMKKQPDITNSMRAILVDWLVEVGEEYKLQNETLHLAVNYIDRFLSSMSVLRGKLQLVGTAAMLLASKFEEIYPPEVAEFVYITDDTYTKKQVLRMEHLVLKVLTFDLAAPTVNQFLTQYFLHQQPANCKVESLAMFLGELSLIDADPYLKYLPSVIAGAAFHLALYTVTGQSWPESLIRKTGYTLESLKPCLMDLHQTYLKAPQHAQQSIREKYKNSKYHGVSLLNPPETLNL

SEQ ID NO: 21 - protein, 295 aa, Homo sapiens
MEHQLLCCEVETIRRAYPDANLLNDRVLRAMLKAEETCAPSVSYFKCVQKEVLPSMRKIVATWMLEVCEEQKCEEEVFPLAMNYLDRFLSLEPVKKSRLQLLGATCMFVASKMKETIPLTAEKLCIYTDNSIRPEELLQMELLLVNKLKWNLAAMTPHDFIEHFLSKMPEAEENKQIIRKHAQTFVALCATDVKFISNPPSMVAAGSVVAAVQGLNLRSPNNFLSYYRLTRFLSRVIKCDPDCLRACQEQIEALLESSLRQAQQNMDPKAAEEEEEEEEEVDLACTPTDVRDVDI

SEQ ID NO: 22 - protein, 268 aa, Homo sapiens
MGSAKSVPVTPARPPPHNKHLARVADPRSPSAGILRTPIQVESSPQPGLPAGEQLEGLKHAQDSDPRSPTLGIARTPMKTSSGDPPSPLVKQLSEVFETEDSKSNLPPEPVLPPEAPLSSELDLPLGTQLSVEEQMPPWNQTEFPSKQVFSKEEARQPTETPVASQSSDKPSRDPETPRSSGSMRNRWKPNSSKVLGRSPLTILQDDNSPGTLTLRQGKRPSPLSENVSELKEGAILGTGRLLKTGGRAWEQGQDHDKENQHFPLVES

SEQ ID NO: 23 - protein, 372 aa, Homo sapiens
MAKQYDSVECPFCDEVSKYEKLAKIGQGTFGEVFKARHRKTGQKVALKKVLMENEKEGFPITALREIKILQLLKHENVVNLIEICRTKASPYNRCKGSIYLVFDFCEHDLAGLLSNVLVKFTLSEIKRVMQMLLNGLYYIHRNKILHRDMKAANVLITRDGVLKLADFGLARAFSLAKNSQPNRYTNRVVTLWYRPPELLLGERDYGPPIDLWGAGCIMAEMWTRSPIMQGNTEQHQLALISQLCGSITPEVWPNVDNYELYEKLELVKGQKRKVKDRLKAYVRDPYALDLIDKLLVLDPAQRIDSDDALNHDFFWSDPMPSDLKGMLSTHLTSMFEYLAPPRRKGSQITQQSTNQSRNPATTNQTEFERVF

SEQ ID NO: 24 - protein, 196 aa, Homo sapiens [sequence omitted]

SEQ ID NO: 25 - protein, 63 aa, Homo sapiens
MLGQSIRRFTTSVVRRSHYEEGPGKNLPFSVENKWSLLAKMCLYFGSAFATPFLVVRHQLLKT

SEQ ID NO: 26 - protein, 2442 aa, Homo sapiens
MAENLLDGPPNPKRAKLSSPGFSANDSTDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKMGITGNTSPFGQPFSQAGGQPMGATGVNPQLASKQSMVNSLPTFPTDIKNTSVTNVPNMSQMQTSVGIVPTQAIATGPTADPEKRKLIQQQLVLLLHAHKCQRREQANGEVRACSLPHCRTMKNVLNHMTHCQAGKACQVAHCASSRQIISHWKNCTRHDCPVCLPLKNASDKRNQQTILGSPASGIQNTIGSVGTGQQNATSLSNPNPIDPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPNGPLSLPVNRMQVSQGMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQGQVPGAALPNPLNMLGPQASQLPCPPVTQSPLHPTPPPASTAAGMPSLQHTTPPGMTPPQPAAPTQPSTPVSSSGQTPTPTPGSVPSATQTQSTPTVQAAAQAQVTPQPQTPVQPPSVATPQSSQQQPTPVHAQPPGTPLSQAAASIDNRVPTPSSVASAETNSQQPGPDVPVLEMKTETQAEDTEPDPGESKGEPRSEMMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLAEVFEQEIDPVMQSLGYCCGRKYEFSPQTLCCYGKQLCTIPRDAAYYSYQNRYHFCEKCFTEIQGENVTLGDDPSQPQTTISKDQFEKKKNDTLDPEPFVDCKECGRKMHQICVLHYDIIWPSGFVCDNCLKKTGRPRKENKFSAKRLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEGSQGDSKNAKKKNNKKTNKNKSSISRANKKKPSMPNVSNDLSQKLYATMEKHKEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRLSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 27 - protein, 466 aa, Homo sapiens [sequence omitted]

SEQ ID NO: 28 - protein, 645 aa, Homo sapiens
MYFPSWLSQLYRGLSRPIRRTTQPIWGSLYRSLLQSSQRRIPEFSSFVVRTNTCGELRSSHLGQEVTLCGWIQYRRQNTFLVLRDFDGLVQVIIPQDESAASVKKILCEAPVESVVQVSGTVISRPAGQENPKMPTGEIEIKVKTAELLNACKKLPFEIKNFVKKTEALRLQYRYLDLRSFQMQYNLRLRSQMVMKMREYLCNLHGFVDIETPTLFKRTPGGAKEFLVPSREPGKFYSLPQSPQQFKQLLMVGGLDRYFQVARCYRDEGSRPDRQPEFTQIDIEMSFVDQTGIQSLIEGLLQYSWPNDKDPVVVPFPTMTFAEVLATYGTDKPDTRFGMKIIDISDVFRNTEIGFLQDALSKPHGTVKAICIPEGAKYLKRKDIESIRNFAADHFNQEILPVFLNANRNWNSPVANFIMESQRLELIRLMETQEEDVVLLTAGEHNKACSLLGKLRLECADLLETRGVVLRDPTLFSFLWVVDFPLFLPKEENPRELESAHHPFTAPHPSDIHLLYTEPKKARSQHYDLVLNGNEIGGGSIRIHNAELQRYILATLLKEDVKMLSHLLQALDYGAPPHGGIALGLDRLICLVTGSPSIRDVIAFPKSFRGHDLMSNTPDSVPPEELKPYHIRVSKPTDSKAERAH

SEQ ID NO: 29 - protein, 337 aa, Homo sapiens
MADAAPQLGKRKRELDVEEAHAASTEEKEAGVGNGTCAPVRLPFSGFRLQKVLRESARDKIIFLHGKVNEASGDGDGEDAVVILEKTPFQVEQVAQLLTGSPELQLQFSNDIYSTYHLFPPRQLNDVKTTVVYPATEKHLQKYLRQDLRLIRETGDDYRNITLPHLESQSLSIQWVYNILDKKAEADRIVFENPDPSDGFVLIPDLKWNQQQLDDLYLIAICHRRGIRSLRDLTPEHLPLLRNILHQGQEAILQRYRMKGDHLRVYLHYLPSYYHLHVHFTALGFEAPGSGVERAHLLAEVIENLECDPRHYQQRTLTFALRADDPLLKLLQEAQQS

SEQ ID NO: 30 - protein, 395 aa, Homo sapiens
MAWRHLKKRAQDAVIILGGGGLLFASYLMATGDERFYAEHLMPTLQGLLDPESAHRLAVRFTSLGLLPRARFQDSDMLEVRVLGHKFRNPVGIAAGFDKHGEAVDGLYKMGFGFVEIGSVTPKPQEGNPRPRVFRLPEDQAVINRYGFNSHGLSVVEHRLRARQQKQAKLTEDGLPLGVNLGKNKTSVDAAEDYAEGVRVLGPLADYLVVNVSSPNTAGLRSLQGKAELRRLLTKVLQERDGLRRVHRPAVLVKIAPDLTSQDKEDIASVVKELGIDGLIVTNTTVSRPAGLQGALRSETGGLSGKPLRDLSTQTIREMYALTQGRVPIIGVGGVSSGQDALEKIRAGASLVQLYTALTFWGPPVVGKVKRELEALLKEQGFGGVTDAIGADHRR

SEQ ID NO: 31 - protein, 475 aa, Homo sapiens
MQVAMNGKARKEAVQTAAKELLKFVNRSPSPFHAVAECRNRLLQAGFSELKETEKWNIKPESKYFMTRNSSTIIAFAVGGQYVPGNGFSLIGAHTDSPCLRVKRRSRRSQVGFQQVGVETYGGGIWSTWFDRDLTLAGRVIVKCPTSGRLEQQLVHVERPILRIPHLAIHLQRNINENFGPNTEMHLVPILATAIQEELEKGTPEPGPLNAVDERHHSVLMSLLCAHLGLSPKDIVEMELCLADTQPAVLGGAYDEFIFAPRLDNLHSCFCALQALIDSCAGPGSLATEPHVRMVTLYDNEEVGSESAQGAQSLLTELVLRRISASCQHPTAFEEAIPKSFMISADMAHAVHPNYLDKHEENHRPLFHKGPVIKVNSKQRYASNAVSEALIREVANKVKVPLQDLMVRNDTPCGTTIGPILASRLGLRVLDLGSPQLAMHSIREMACTTGVLQTLTLFKGFFELFPSLSHNLLVD

SEQ ID NO: 32 - protein, 212 aa, Homo sapiens
MAARRGALIVLEGVDRAGKSTQSRKLVEALCAAGHRAELLRFPERSTEIGKLLSSYLQKKSDVEDHSVHLLFSANRWEQVPLIKEKLSQGVTLVVDRYAFSGVAFTGAKENFSLDWCKQPDVGLPKPDLVLFLQLQLADAAKRGAFGHERYENGAFQERALRCFHQLMKDTTLNWKMVDASKSIEAVHEDIRVLSEDAIRTATEKPLGELWK

SEQ ID NO: 33 - protein, 523 aa, Homo sapiens
MAALLRRLLQRERPSAASGRPVGRREANLGTDAGVAVRVRFAPSPTGFLHLGGLRTALYNYIFAKKYQGSFILRLEDTDQTRVVPGAAENIEDMLEWAGIPPDESPRRGGPAGPYQQSQRLELYAQATEALLKTGAAYPCFCSPQRLELLKKEALRNHQTPRYDNRCRNMSQEQVAQKLAKDPKPAIRFRLEQVVPAFQDLVYGWNRHEVASVEGDPVIMKSDGFPTYHLACVVDDHHMGISHVLRGSEWLVSTAKHLLLYQALGWQPPHFAHLPLLLNRDGSKLSKRQGDVFLEHFAADGFLPDSLLDIITNCGSGFAENQMGRTLPELITQFNLTQVTCHSALLDLEKLPEFNRLHLQRLVSNESQRRQLVGKLQVLVEEAFGCQLQNRDVLNPVYVERILLLRQGHICRLQDLVSPVYSYLWTRPAVGRAQLDAISEKVDVIAKRVLGLLERSSMSLTQDMLNGELKKLSEGLEGTKYSNVMKLLRMALSGQQQGPPVAEMMLALGPKEVRERIQKVVSS

SEQ ID NO: 34 - protein, 858 aa, Homo sapiens
MVNFTVDQIRAIMDKKANIRNMSVIAHVDHGKSTLTDSLVCKAGIIASARAGETRFTDTRKDEQERCITIKSTAISLFYELSENDLNFIKQSKDGAGFLINLIDSPGHVDFSSEVTAALRVTDGALVVVDCVSGVCVQTETVLRQAIAERIKPVLMMNKMDRALLELQLEPEELYQTFQRIVENVNVIISTYGEGESGPMGNIMIDPVLGTVGFGSGLHGWAFTLKQFAEMYVAKFAAKGEGQLGPAERAKKVEDMMKKLWGDRYFDPANGKFSKSATSPEGKKLPRTFCQLILDPIFKVFDAIMNFKKEETAKLIEKLDIKLDSEDKDKEGKPLLKAVMRRWLPAGDALLQMITIHLPSPVTAQKYRCELLYEGPPDDEAAMGIKSCDPKGPLMMYISKMVPTSDKGRFYAFGRVFSGLVSTGLKVRIMGPNYTPGKKEDLYLKPIQRTILMMGRYVEPIEDVPCGNIVGLVGVDQFLVKTGTITTFEHAHNMRVMKFSVSPVVRVAVEAKNPADLPKLVEGLKRLAKSDPMVQCIIEESGEHIIAGAGELHLEICLKDLEEDHACIPIKKSDPVVSYRETVSEESNVLCLSKSPNKHNRLYMKARPFPDGLAEDIDKGEVSARQELKQRARYLAEKYEWDVAEARKIWCFGPDGTGPNILTDITKGVQYLNEIKDSVVAGFQWATKEGALCEENMRGVRFDVHDVTLHADAIHRGGGQIIPTARRCLYASVLTAQPRLMEPIYLVEIQCPEQVVGGIYGVLNRKRGHVFEESQVAGTPMFVVKAYLPVNESFGFTADLRSNTGGQAFPQCVFDHWQILPGDPFDNSSRPSQVVAETRKRKGLKEGIPALDNFLDKL

SEQ ID NO: 35 - protein, 1298 aa, Homo sapiens
MAAADAEAVPARGEPQQDCCVKTELLGEETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTACLPFVLAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYERIPIPCVNAVDSEPCPSNYKYVSQNCVTSPMNIDRNITHLQYCVCIDDCSSSNCMCGQLSMRCWYDKDGRLLPEFNMAEPPLIFECNHACSCWRNCRNRVVQNGLRARLQLYRTRDMGWGVRSLQDIPPGTFVCEYVGELISDSEADVREEDSYLFDLDNKDGEVYCIDARFYGNVSRFINHHCEPNLVPVRVFMAHQDLRFPRIAFFSTRLIEAGEQLGFDYGERFWDIKGKLFSCRCGSPKCRHSSAALAQRQASAAQEAQEDGLPDTSSAAAADPL

SEQ ID NO: 36 - protein, 2414 aa, Homo sapiens
MAENVVEPGPPSAKRPKLSSPALSASASDGTDFGSLFDLEHDLPDELINSTELGLTNGGDINQLQTSLGMVQDAASKHKQLSELLRSGSSPNLNMGVGGPGQVMASQAQQSSPGLGLINSMVKSPMTQAGLTSPNMGMGTSGPNQGPTQSTGMMNSPVNQPAMGMNTGMNAGMNPGMLAAGNGQGIMPNQVMNGSIGAGRGRQNMQYPNPGMGSAGNLLTEPLQQGSPQMGGQTGLRGPQPLKMGMMNNPNPYGSPYTQNPGQQIGASGLGLQIQTKTVLSNNLSPFAMDKKAVPGGGMPNMGQQPAPQVQQPGLVTPVAQGMGSGAHTADPEKRKLIQQQLVLLLHAHKCQRREQANGEVRQCNLPHCRTMKNVLNHMTHCQSGKSCQVAHCASSRQIISHWKNCTRHDCPVCLPLKNAGDKRNQQPILTGAPVGLGNPSSLGVGQQSAPNLSTVSQIDPSSIERAYAALGLPYQVNQMPTQPQVQAKNQQNQQPGQSPQGMRPMSNMSASPMGVNGGVGVQTPSLLSDSMLHSAINSQNPMMSENASVPSLGPMPTAAQPSTTGIRKQWHEDITQDLRNHLVHKLVQAIFPTPDPAALKDRRMENLVAYARKVEGDMYESANNRAEYYHLLAEKIYKIQKELEEKRRTRLQKQNMLPNAAGMVPVSMNPGPNMGQPQPGMTSNGPLPDPSMIRGSVPNQMMPRITPQSGLNQFGQMSMAQPPIVPRQTPPLQHHGQLAQPGALNPPMGYGPRMQQPSNQGQFLPQTQFPSQGMNVTNIPLAPSSGQAPVSQAQMSSSSCPVNSPIMPPGSQGSHIHCPQLPQPALHQNSPSPVPSRTPTPHHTPPSIGAQQPPATTIPAPVPTPPAMPPGPQSQALHPPPRQTPTPPTTQLPQQVQPSLPAAPSADQPQQQPRSQQSTAASVPTPTAPLLPPQPATPLSQPAVSIEGQVSNPPSTSSTEVNSQAIAEKQPSQEVKMEAKMEVDQPEPADTQPEDISESKVEDCKMESTETEERSTELKTEIKEEEDQPSTSATQSSPAPGQSKKKIFKPEELRQALMPTLEALYRQDPESLPFRQPVDPQLLGIPDYFDIVKSPMDLSTIKRKLDTGQYQEPWQYVDDIWLMFNNAWLYNRKTSRVYKYCSKLSEVFEQEIDPVMQSLGYCCGRKLEFSPQTLCCYGKQLCTIPRDATYYSYQNRYHFCEKCFNEIQGESVSLGDDPSQPQTTINKEQFSKRKNDTLDPELFVECTECGRKMHQICVLHHEIIWPAGFVCDGCLKKSARTRKENKFSAKRLPSTRLGTFLENRVNDFLRRQNHPESGEVTVRVVHASDKTVEVKPGMKARFVDSGEMAESFPYRTKALFAFEEIDGVDLCFFGMHVQEYGSDCPPPNQRRVYISYLDSVHFFRPKCLRTAVYHEILIGYLEYVKKLGYTTGHIWACPPSEGDDYIFHCHPPDQKIPKPKRLQEWYKKMLDKAVSERIVHDYKDIFKQATEDRLTSAKELPYFEGDFWPNVLEESIKELEQEEEERKREENTSNESTDVTKGDSKNAKKKNNKKTSKNKSSLSRGNKKKPGMPNVSNDLSQKLYATMEKHKEVFFVIRLIAGPAANSLPPIVDPDPLIPCDLMDGRDAFLTLARDKHLEFSSLRRAQWSTMCMLVELHTQSQDRFVYTCNECKHHVETRWHCTVCEDYDLCITCYNTKNHDHKMEKLGLGLDDESNNQQAAATQSPGDSRRLSIQRCIQSLVHACQCRNANCSLPSCQKMKRVVQHTKGCKRKTNGGCPICKQLIALCCYHAKHCQENKCPVPFCLNIKQKLRQQQLQHRLQQAQMLRRRMASMQRTGVVGQQQGLPSPTPATPTTPTGQQPTTPQTPQPTSQPQPTPPNSMPPYLPRTQAAGPVSQGKAAGQVTPPTPPQTAQPPLPGPPPAAVEMAMQIQRAAETQRQMAHVQIFQRPIQHQMPPMTPMAPMGMNPPPMTRGPSGHLEPGMGPTGMQQQPPWSQGGLPQPQQLQSGMPRPAMMSVAQHGQPLNMAPQPGLGQVGISPLKPGTVSQQALQNLLRTLRSPSSPLQQQQVLSILHANPQLLAAFIKQRAAKYANSNPQPIPGQPGMPQGQPGLQPPTMPGQQGVHSNPAMQNMNPMQAGVQRAGLPQQQPQQQLQPPMGGMSPQAQQMNMNHNTMPSQFRDILRRQQMMQQQQQQGAGPGIGPGMANHNQFQQPQGVGYPPQQQQRMQHHMQQMQQGNMGQIGQLPQALGAEAGASLQAYQQRLLQQQMGSPVQPNPMSPQQHMLPNQAQSPHLQGQQIPNSLSNQVRSPQPVPSPRPQSQPPHSSPSPRMQPQPSPHHVSPQTSSPHPGLVAAQANPMEQGHFASPDQNSMLSQLASNPGMANLHGASATDLGLSTDNSDLNSNLSQSTLDIH

SEQ ID NO: 37 - protein, 760 aa, Homo sapiens
MKLNVDGLLVYFPYDYIYPEQFSYMRELKRTLDAKGHGVLEMPSGTGKTVSLLALIMAYQRAYPLEVTKLIYCSRTVPEIEKVIEELRKLLNFYEKQEGEKLPFLGLALSSRKNLCIHPEVTPLRFGKDVDGKCHSLTASYVRAQYQHDTSLPHCRFYEEFDAHGREVPLPAGIYNLDDLKALGRRQGWCPYFLARYSILHANVVVYSYHYLLDPKIADLVSKELARKAVVVFDEAHNIDNVCIDSMSVNLTRRTLDRCQGNLETLQKTVLRIKETDEQRLRDEYRRLVEGLREASAARETDAHLANPVLPDEVLQEAVPGSIRTAEHFLGFLRRLLEYVKWRLRVQHVVQESPPAFLSGLAQRVCIQRKPLRFCAERLRSLLHTLEITDLADFSPLTLLANFATLVSTYAKGFTIIIEPFDDRTPTIANPILHFSCMDASLAIKPVFERFQSVIITSGTLSPLDIYPKILDFHPVTMATFTMTLARVCLCPMIIGRGNDQVAISSKFETREDIAVIRNYGNLLLEMSAVVPDGIVAFFTSYQYMESTVASWYEQGILENIQRNKLLFIETQDGAETSVALEKYQEACENGRGAILLSVARGKVSEGIDFVHHYGRAVIMFGVPYVYTQSRILKARLEYLRDQFQIRENDFLTFDAMRHAAQCVGRAIRGKTDYGLMVFADKRFARGDKRGKLPRWIQEHLTDANLNLTVDEGVQVAKYFLRQMAQPFHREDQLGLSLLSLEQLESEETLKRIEQIAQQL

SEQ ID NO: 38 - protein, 589 aa, Homo sapiens
MPTVSVKRDLLFQALGRTYTDEEFDELCFEFGLELDEITSEKEIISKEQGNVKAAGASDVVLYKIDVPANRYDLLCLEGLVRGLQVFKERIKAPVYKRVMPDGKIQKLIITEETAKIRPFAVAAVLRNIKFTKDRYDSFIELQEKLHQNICRKRALVAIGTHDLDTLSGPFTYTAKRPSDIKFKPLNKTKEYTACELMNIYKTDNHLKHYLHIIENKPLYPVIYDSNGVVLSMPPIINGDHSRITVNTRNIFIECTGTDFTKAKIVLDIIVTMFSEYCENQFTVEAAEVVFPNGKSHTFPELAYRKEMVRADLINKKVGIRETPENLAKLLTRMYLKSEVIGDGNQIEIEIPPTRADIIHACDIVEDAAIAYGYNNIQMTLPKTYTIANQFPLNKLTELLRHDMAAAGFTEALTFALCSQEDIADKLGVDISATKAVHISNPKTAEFQVARTTLLPGLLKTIAANRKMPLPLKLFEISDIVIKDSNTDVGAKNYRHLCAVYYNKNPGFEIIHGLLDRIMQLLDVPPGEDKGGYVIKASEGPAFFPGRCAEIFARGQSVGKLGVLHPDVITKFELTMPCSSLEINVGPFL

SEQ ID NO: 39 - protein, 491 aa, Homo sapiens
MASRCWRWWGWSAWPRTRLPPAGSTPSFCHHFSTQEKTPQICVVGSGPAGFYTAQHLLKHPQAHVDIYEKQPVPFGLVRFGVAPDHPEVKNVINTFTQTAHSGRCAFWGNVEVGRDVTVPELREAYHAVVLSYGAEDHRALEIPGEELPGVCSARAFVGWYNGLPENQELEPDLSCDTAVILGQGNVALDVARILLTPPEHLERTDITKAALGVLRQSRVKTVWLVGRRGPLQVAFTIKELREMIQLPGARPILDPVDFLGLQDKIKEVPRPRKRLTELLLRTATEKPGPAEAARQASASRAWGLRFFRSPQQVLPSPDGRRAAGVRLAVTRLEGVDEATRAVPTGDMEDLPCGLVLSSIGYKSRPVDPSVPFDSKLGVIPNVEGRVMDVPGLYCSGWVKRGPTGVIATTMTDSFLTGQMLLQDLKAGLLPSGPRPGYAAIQALLSSRGVRPVSFSDWEKLDAEEVARGQGTGKPREKLVDPQEMLRLLGH

SEQ ID NO: 40 - protein, 587 aa, Homo sapiens
MSRARSHLRAALFLAAASARGITTQVAARRGLSAWPVPQEPSMEYQDAVRMLNTLQTNAGYLEQVKRQRGDPQTQLEAMELYLARSGLQVEDLDRLNIIHVTGTKGKGSTCAFTECILRSYGLKTGFFSSPHLVQVRERIRINGQPISPELFTKYFWRLYHRLEETKDGSCVSMPPYFRFLTLMAFHVFLQEKVDLAVVEVGIGGAYDCTNIIRKPVVCGVSSLGIDHTSLLGDTVEKIAWQKGGIFKQGVPAFTVLQPEGPLAVLRDRAQQISCPLYLCPMLEALEEGGPPLTLGLEGEHQRSNAALALQLAHCWLQRQDRHGAGEPKASRPGLLWQLPLAPVFQPTSHMRLGLRNTEWPGRTQVLRRGPLTWYLDGAHTASSAQACVRWFRQALQGRERPSGGPEVRVLLFNATGDRDPAALLKLLQPCQFDYAVFCPNLTEVSSTGNADQQNFTVTLDQVLLRCLEHQQHWNHLDEEQASPDLWSAPSPEPGGSASLLLAPHPPHTCSASSLVFSCISHALQWISQGRDPIFQPPSPPKGLLTHPVAHSGASILREAAAIHVLVTGSLHLVGGVLKLLEPALSQ

SEQ ID NO: 41 - protein, 632 aa, Homo sapiens
MGIRGMLRAAVILLLIRTWLAEGNYPSPIPKFHFEFSSAVPEVVLNLFNCKNCANEAVVQKILDRVLSRYDVRLRPNFGGAPVPVRISIYVTSIEQISEMNMDYTITMFFHQTWKDSRLAYYETTLNLTLDYRMHEKLWVPDCYFLNSKDAFVHDVTVENRVFQLHPDGTVRYGIRLTTTAACSLDLHKFPMDKQACNLVVESYGYTVEDIILFWDDNGNAIHMTEELHIPQFTFLGRTITSKEVYFYTGSYIRLILKFQVQREVNSYLVQVYWPTVLTTITSWISFWMNYDSSAARVTIGLTSMLILTTIDSHLRDKLPNISCIKAIDIYILVCLFFVFLSLLEYVYINYLFYSRGPRRQPRRHRRPRRVIARYRYQQVVVGNVQDGLINVEDGVSSLPITPAQAPLASPESLGSLTSTSEQAQLATSESLSPLTSLSGQAPLATGESLSDLPSTSEQARHSYGVRFNGFQADDSIFPTEIRNRVEAHGHGVTHDHEDSNESLSSDERHGHGPSGKPMLHHGEKGVQEAGWDLDDNNDKSDCLAIKEQFKCDTNSTWGLNDDELMAHGQEKDSSSESEDSCPPSPGCSFTEGFSFDLFNPDYVPKVDKWSRFLFPLAFGLFNIVYWVYHMY

SEQ ID NO: 42 - protein, 335 aa, Homo sapiens
MGKVKVGVNGFGRIGRLVTRAAFNSGKVDIVAINDPFIDLNYMVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 43 - protein, 637 aa, Homo sapiens
MGLLSQGSPLSWEETKRHADHVRRHGILQFLHIYHAVKDRHKDVLKWGDEVEYMLVSFDHENKKVRLVLSGEKVLETLQEKGERTNPNHPTLWRPEYGSYMIEGTPGQPYGGTMSEFNTVEANMRKRRKEATSILEENQALCTITSFPRLGCPGFTLPEVKPNPVEGGASKSLFFPDEAINKHPRFSTLTRNIRHRRGEKVVINVPIFKDKNTPSPFIETFTEDDEASRASKPDHIYMDAMGFGMGNCCLQVTFQACSISEARYLYDQLATICPIVMALSAASPFYRGYVSDIDCRWGVISASVDDRTREERGLEPLKNNNYRISKSRYDSIDSYLSKCGEKYNDIDLTIDKEIYEQLLQEGIDHLLAQHVAHLFIRDPLTLFEEKIHLDDANESDHFENIQSTNWQTMRFKPPPPNSDIGWRVEFRPMEVQLTDFENSAYVVFVVLLTRVILSYKLDFLIPLSKVDENMKVAQKRDAVLQGMFYFRKDICKGGNAVVDGCGKAQNSTELAAEEYTLMSIDTIINGKEGVFPGLIPILNSYLENMEVDVDTRCSILNYLKLIKKRASGELMTVARWMREFIANHPDYKQDSVITDEMNYSLILKCNQIANELCECPELLGSAFRKVKYSGSKTDSSN

SEQ ID NO: 44 - protein, 373 aa, Homo sapiens
MTTSASSHLNKGIKQVYMSLPQGEKVQAMYIWIDGTGEGLRCKTRTLDSEPKCVEELPEWNFDGSSTLQSEGSNSDMYLVPAAMFRDPFRKDPNKLVLCEVFKYNRRPAETNLRHTCKRIMDMVSNQHPWFGMEQEYTLMGTDGHPFGWPSNGFPGPQGPYYCGVGADRAYGRDIVEAHYRACLYAGVKIAGTNAEVMPAQWEFQIGPCEGISMGDHLWVARFILHRVCEDFGVIATFDPKPIPGNWNGAGCHTNFSTKAMREENGLKYIEEAIEKLSKRHQYHIRAYDPKGGLDNARRLTGFHETSNINDFSAGVANRSASIRIPRTVGQEKKGYFEDRRPSANCDPFSVTEALIRTCLLNETGDEPFQYKN

SEQ ID NO: 45 - protein, 782 aa, Homo sapiens
MAPHRPAPALLCALSLALCALSLPVRAATASRGASQAGAPQGRVPEARPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 46 - protein, 509 aa, Homo sapiens
MAERAALEELVKLQGERVRGLKQQKASAELIEEEVAKLLKLKAQLGPDESKQKFVLKTPKGTRDYSPRQMAVREKVFDVIIRCFKRHGAEVIDTPVFELKETLMGKYGEDSKLIYDLKDQGGELLSLRYDLTVPFARYLAMNKLTNIKRYHIAKVYRRDNPAMTRGRYREFYQCDFDIAGNFDPMIPDAECLKIMCEILSSLQIGDFLVKVNDRRILDGMFAICGVSDSKFRTICSSVDKLDKVSWEEVKNEMVGEKGLAPEVADRIGDYVQQHGGVSLVEQLLQDPKLSQNKQALEGLGDLKLLFEYLTLFGIDDKISFDLSLARGLDYYTGVIYEAVLLQTPAQAGEEPLGVGSVAAGGRYDGLVGMFDPKGRKVPCVGLSIGVERIFSIVEQRLEALEEKIRTTETQVLVASAQKKLLEERLKLVSELWDAGIKAELLYKKNPKLLNQLQYCEEAGIPLVAIIGEQELKDGVIKLRSVTSREEVDVRREDLVEEIKRRTGQPLCIC

SEQ ID NO: 47 - protein, 488 aa, Homo sapiens
MAYSQGGGKKKVCYYYDGDIGNYYYGQGHPMKPHRIRMTHNLLLNYGLYRKMEIYRPHKATAEEMTKYHSDEYIKFLRSIRPDNMSEYSKQMQRFNVGEDCPVFDGLFEFCQLSTGGSVAGAVKLNRQQTDMAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNFPMRDGIDDESYGQIFKPIISKVMEMYQPSAVVLQCGADSLSGDRLGCFNLTVKGHAKCVEVVKTFNLPLLMLGGGGYTIRNVARCWTYETAVALDCEIPNELPYNDYFEYFGPDFKLHISPSNMTNQNTPEYMEKIKQRLFENLRMLPHAPGVQMQAIPEDAVHEDSGDEDGEDPDKRISIRASDKRIACDEEFSDSEDEGEGGRRNVADHKKGAKKARIEEDKKETEDKKTDVKEEDKSKDNSGEKTDTKGTKSEQLSNP

SEQ ID NO: 48 - protein, 520 aa, Homo sapiens
MPGSLPLNAEACWPKDVGIVALEIYFPSQYVDQAELEKYDGVDAGKYTIGLGQAKMGFCTDREDINSLCMTVVQNLMERNNLSYDCIGRLEVGTETIIDKSKSVKTNLMQLFEESGNTDIEGIDTTNACYGGTAAVFNAVNWIESSSWDGRYALVVAGDIAVYATGNARPTGGVGAVALLIGPNAPLIFERGLRGTHMQHAYDFYKPDMLSEYPIVDGKLSIQCYLSALDRCYSVYCKKIHAQWQKEGNDKDFTLNDFGFMIFHSPYCKLVQKSLARMLLNDFLNDQNRDKNSIYSGLEAFGDVKLEDTYFDRDVEKAFMKASSELFSQKTKASLLVSNQNGNMYTSSVYGSLASVLAQYSPQQLAGKRIGVFSYGSGLAATLYSLKVTQDATPGSALDKITASLCDLKSRLDSRTGVAPDVFAENMKLREDTHHLVNYIPQGSIDSLFEGTWYLVRVDEKHRRTYARRPTPNDDTLDEGVGLVHSNIATEHIPSPAKKVPRLPATAAEPEAAVISNGEH

SEQ ID NO: 49 - protein, 724 aa, Homo sapiens
MPEEVHHGEEEVETFAFQAEIAQLMSLIINTFYSNKEIFLRELISNASDALDKIRYESLTDPSKLDSGKELKIDIIPNPQERTLTLVDTGIGMTKADLINNLGTIAKSGTKAFMEALQAGADISMIGQFGVGFYSAYLVAEKVVVITKHNDDEQYAWESSAGGSFTVRADHGEPIGRGTKVILHLKEDQTEYLEERRVKEVVKKHSQFIGYPITLYLEKEREKEISDDEAEEEKGEKEEEDKDDEEKPKIEDVGSDEEDDSGKDKKKKTKKIKEKYIDQEELNKTKPIWTRNPDDITQEEYGEFYKSLTNDWEDHLAVKHFSVEGQLEFRALLFIPRRAPFDLFENKKKKNNIKLYVRRVFIMDSCDELIPEYLNFIRGVVDSEDLPLNISREMLQQSKILKVIRKNIVKKCLELFSELAEDKENYKKFYEAFSKNLKLGIHEDSTNRRRLSELLRYHTSQSGDEMTSLSEYVSRMKETQKSIYYITGESKEQVANSAFVERVRKRGFEVVYMTEPIDEYCVQQLKEFDGKSLVSVTKEGLELPEDEEEKKKMEESKAKFENLCKLMKEILDKKVEKVTISNRLVSSPCCIVTSTYGWTANMERIMKAQALRDNSTMGYMMAKKHLEINPDHPIVETLRQKAEADKNDKAVKDLVVLLFETALLSSGFSLEDPQTHSNRIYRMIKLGLGIDEDEVAAEEPNAAVPDEIPPLEGDEDASRMEEVD

SEQ ID NO: 50 - protein, 1012 aa, Homo sapiens
MRWGLRPRGPGAAALATARSLWGTPRLPCSPGWQGATKRLLVRSVSGASNHQPNSNSGRYRDTVLLPQTSFPMKLLGRQQPDTELEIQQKCGFSELYSWQRERKVKTEFCLHDGPPYANGDPHVGHALNKILKDIANRFHMMNGSKIHFVPGWDCHGLPIEIKVLSELGREAQNLSAMEIRKKARSFAKAAIEKQKSAFIRWGIMADWNNCYYTFDGKYEAKQLRTFYQMYDKGLVYRSYKPVFWSPSSRTALAEAELEYNPEHVSRSIYVKFPLLKPSPKLASLIDGSSPVSILVWTTQPWTIPANEAVCYMPESKYAVVKCSKSGDLYVLAADKVASVASTLETTFETISTLSGVDLENGTCSHPLIPDKASPLLPANHVTMAKGTGLVHTAPAHGMEDYGVASQHNLPMDCLVDEDGVFTDVAGPELQNKAVLEEGTDVVIKMLQTAKNLLKEEKLVHSYPYDWRTKKPVVIRASKQWFINITDIKTAAKELLKKVKFIPGSALNGMVEMMDRRPYWCISRQRVWGVPIPVFHHKTKDEYLINSQTTEHIVKLVEQHGSDIWWTLPPEQLLPKEVLSEVGGPDALEYVPGQDILDIWFDSGTSWSYVLPGPDQRADLYLEGKDQLGGWFQSSLLTSVAARKRAPYKTVIVHGFTLGEKGEKMSKSLGNVIHPDVVVNGGQDQSKEPPYGADVLRWWVADSNVFTEVAIGPSVLNAARDDISKLRNTLRFLLGNVADFNPETDSIPVNDMYVIDQYMLHLLQDLANKITELYKQYDFGKVVRLLRTFYTRELSNFYFSIIKDRLYCEKENDPKRRSCQTALVEILDVIVRSFAPILPHLAEEVFQHIPYIKEPKSVFRTGWISTSSIWKKPGLEEAVESACAMRDSFLGSIPGKNAAEYKVITVIEPGLLFEIIEMLQSEETSSTSQLNELMMASESTLLAQEPREMTADVIELKGKFLINLEGGDIREESSYKVIVMPTTKEKCPRCWKYTAESSDTLCPRCAEVVSGK

SEQ ID NO: 51 - protein, 597 aa, Homo sapiens
MAAVQAAEVKVDGSEPKLSKNELKRRLKAEKKVAEKEAKQKELSEKQLSQATAAATNHTTDNGVGPEEESVDPNQYYKIRSQAIHQLKVNGEDPYPHKFHVDISLTDFIQKYSHLQPGDHLTDITLKVAGRIHAKRASGGKLIFYDLRGEGVKLQVMANSRNYKSEEEFIHINNKLRRGDIIGVQGNPGKTKKGELSIIPYEITLLSPCLHMLPHLHFGLKDKETRYRQRYLDLILNDFVRQKFIIRSKIITYIRSFLDELGFLEIETPMMNIIPGGAVAKPFITYHNELDMNLYMRIAPELYHKMLVVGGIDRVYEIGRQFRNEGIDLTHNPEFTTCEFYMAYADYHDLMEITEKMVSGMVKHITGSYKVTYHPDGPEGQAYDVDFTPPFRRINMVEELEKALGMKLPETNLFETEETRKILDDICVAKAVECPPPRTTARLLDKLVGEFLEVTCINPTFICDHPQIMSPLAKWHRSKEGLTERFELFVMKKEICNAYTELNDPMRQRQLFEEQAKAKAAGDDEAMFIDENFCTALEYGLPPTAGWGMGIDRVAMFLTDSNNIKEVLLFPAMKPEDKKENVATTDTLESTTVGTSV

SEQ ID NO: 52 - protein, 1162 aa, Homo sapiens
MEPEEERIRYSQRLRGTMRRRYEDDGISDDEIEGKRTFDLEEKLHTNKYNANFVTFMEGKDFNVEYIQRGGLRDPLIFKNSDGLGIKMPDPDFTVNDVKMCVGSRRMVDVMDVNTQKGIEMTMAQWTRYYETPEEEREKLYNVISLEFSHTRLENMVQRPSTVDFIDWVDNMWPRHLKESQTESTNAILEMQYPKVQKYCLMSVRGCYTDFHVDFGGTSVWYHIHQGGKVFWLIPPTAHNLELYENWLLSGKQGDIFLGDRVSDCQRIELKQGYTFVIPSGWIHAVYTPTDTLVFGGNFLHSFNIPMQLKIYNIEDRTRVPNKFRYPFYYEMCWYVLERYVYCITNRSHLTKEFQKESLSMDLELNGLESGNGDEEAVDREPRRLSSRRSVLTSPVANGVNLDYDGLGKTCRSLPSLKKTLAGDSSSDCSRGSHNGQVWDPQCAPRKDRQVHLTHFELEGLRCLVDKLESLPLHKKCVPTGIEDEDALIADVKILLEELANSDPKLALTGVPIVQWPKRDKLKFPTRPKVRVPTIPITKPHTMKPAPRLTPVRPAAASPIVSGARRRRVRCRKCKACVQGECGVCHYCRDMKKFGGPGRMKQSCVLRQCLAPRLPHSVTCSLCGEVDQNEETQDFEKKLMECCICNEIVHPGCLQMDGEGLLNEELPNCWECPKCYQEDSSEKAQKRKMEESDEEAVQAKVLRPLRSCDEPLTPPPHSPTSMLQLIHDPVSPRGMVTRSSPGAGPSDHHSASRDERFKRRQLLRLQATERTMVREKENNPSGKKELSEVEKAKIRGSYLTVTLQRPTKELHGTSIVPKLQAITASSANLRHSPRVLVQHCPARTPQRGDEEGLGGEEEEEEEEEEEDDSAEEGGAARLNGRGSWAQDGDESWMQREVWMSVFRYLSRRELCECMRVCKTWYKWCCDKRLWTKIDLSRCKAIVPQALSGIIKRQPVSLDLSWTNISKKQLTWLVNRLPGLKDLLLAGCSWSAVSALSTSSCPLLRTLDLRWAVGIKDPQIRDLLTPPADKPGQDNRSKLRNMTDFRLAGLDITDATLRLIIRHMPLLSRLDLSHCSHLTDQSSNLLTAVGSSTRYSLTELNMAGCNKLTDQTLIYLRRIANVTLIDLRGCKQITRKACEHFISDLSINSLYCLSDEKLIQKIS

SEQ ID NO: 53 - protein, 624 aa, Homo sapiens
MQPDPRPSGAGACCRFLPLQSQCPEGAGDAVMYASTECKAEVTPSQHGNRTFSYTLEDHTKQAFGIMNELRLSQQLCDVTLQVKYQDAPAAQFMAHKVVLASSSPVFKAMFTNGLREQGMEVVSIEGIHPKVMERLIEFAYTASISMGEKCVLHVMNGAVMYQIDSVVRACSDFLVQQLDPSNAIGIANFAEQIGCVELHQRAREYIYMHFGEVAKQEEFFNLSHCQLVTLISRDDLNVRCESEVFHACINWVKYDCEQRRFYVQALLRAVRCHSLTPNFLQMQLQKCEILQSDSRCKDYLVKIFEELTLHKPTQVMPCRAPKVGRLIYTAGGYFRQSLSYLEAYNPSDGTWLRLADLQVPRSGLAGCVVGGLLYAVGGRNNSPDGNTDSSALDCYNPMTNQWSPCAPMSVPRNRIGVGVIDGHIYAVGGSHGCIHHNSVERYEPERDEWHLVAPMLTRRIGVGVAVLNRLLYAVGGFDGTNRLNSAECYYPERNEWRMITAMNTIRSGAGVCVLHNCIYAAGGYDGQDQLNSVERYDVETETWTFVAPMKHRRSALGITVHQGRIYVLGGYDGHTFLDSVECYDPDTDTWSEVTRMTSGRSGVGVAVTMEPCRKQIDQQNCTC

SEQ ID NO: 54 - protein, 725 aa, Homo sapiens
MAMDSSLQARLFPGLAIKIQRSNGLIHSANVRTVNLEKSCVSVEWAEGGATKGKEIDFDDVAAINPELLQLLPLHPKDNLPLQENVTIQKQKRRSVNSKIPAPKESLRSRSTRMSTVSELRITAQENDMEVELPAAANSRKQFSVPPAPTRPSCPAVAEIPLRMVSEEMEEQVHSIRGSSSANPVNSVRRKSCLVKEVEKMKNKREEKKAQNSEMRMKRAQEYDSSFPNWEFARMIKEFRATLECHPLTMTDPIEEHRICVCVRKRPLNKQELAKKEIDVISIPSKCLLLVHEPKLKVDLTKYLENQAFCFDFAFDETASNEVVYRFTARPLVQTIFEGGKATCFAYGQTGSGKTHTMGGDLSGKAQNASKGIYAMASRDVFLLKNQPCYRKLGLEVYVTFFEIYNGKLFDLLNKKAKLRVLEDGKQQVQVVGLQEHLVNSADDVIKMIDMGSACRTSGQTFANSNSSRSHACFQIILRAKGRMHGKFSLVDLAGNERGADTSSADRQTRMEGAEINKSLLALKECIRALGQNKAHTPFRESKLTQVLRDSFIGENSRTCMIATISPGISSCEYTLNTLRYADRVKELSPHSGPSGEQLIQMETEEMEACSNGALIPGNLSKEEEELSSQMSSFNEAMTQIRELEEKAMEELKEIIQQGPDWLELSEMTEQPDYDLETFVNKAESALAQQAKHFSALRDVIKALRLAMQLEEQASRQISSKKRPQ

SEQ ID NO: 55 - protein, 903 aa, Homo sapiens
MASVWQRLGFYASLLKRQLNGGPDVIKWERRVIPGCTRSIYSATGKWTKEYTLQTRKDVEKWWHQRIKEQASKISEADKSKPKFYVLSMFPYPSGKLHMGHVRVYTISDTIARFQKMRGMQVINPMGWDAFGLPAENAAVERNLHPQSWTQSNIKHMRKQLDRLGLCFSWDREITTCLPDYYKWTQYLFIKLYEAGLAYQKEALVNWDPVDQTVLANEQVDEHGCSWRSGAKVEQKYLRQWFIKTTAYAKAMQDALADLPEWYGIKGMQAHWIGDCVGCHLDFTLKVHGQATGEKLTAYTATPEAIYGTSHVAISPSHRLLHGHSSLKEALRMALVPGKDCLTPVMAVNMLTQQEVPVVILAKADLEGSLDSKIGIPSTSSEDTILAQTLGLAYSEVIETLPDGTERLSSSAEFTGMTRQDAFLALTQKARGKRVGGDVTSDKLKDWLISRQRYWGTPIPIVHCPVCGPTPVPLEDLPVTLPNIASFTGKGGPPLAMASEWVNCSCPRCKGAAKRETDTMDTFVDSAWYYFRYTDPHNPHSPFNTAVADYWMPVDLYIGGKEHAVMHLFYARFFSHFCHDQKMVKHREPFHKLLAQGLIKGQTFRLPSGQYLQREEVDLTGSVPVHAKTKEKLEVTWEKMSKSKHNGVDPEEVVEQYGIDTIRLYILFAAPPEKDILWDVKTDALPGVLRWQQRLWTLTTRFIEARASGKSPQPQLLSNKEKAEARKLWEYKNSVISQVTTHFTEDFSLNSAISQLMGLSNALSQASQSVILHSPEFEDALCALMVMAAPLAPHVTSEIWAGLALVPRKLCAHYTWDASVLLQAWPAVDPEFLQQPEVVQMAVLINNKACGKIPVPQQVARDQDKVHEFVLQSELGVRLLQGRSIKKSFLSPRTALINFLVQD

SEQ ID NO: 56 - protein, 360 aa, Homo sapiens [sequence omitted]

SEQ ID NO: 57 - protein, 386 aa, Homo sapiens [sequence omitted]

SEQ ID NO: 58 - protein, 520 aa, Homo sapiens
MVARVGLLLRALQLLLWGHLDAQPAERGGQELRKEAEAFLEKYGYLNEQVPKAPTSTRFSDAIRAFQWVSQLPVSGVLDRATLRQMTRPRCGVTDTNSYAAWAERISDLFARHRTKMRRKKRFAKQGNKWYKQHLSYRLVNWPEHLPEPAVRGAVRAAFQLWSNVSALEFWEAPATGPADIRLTFFQGDHNDGLGNAFDGPGGALAHAFLPRRGEAHFDQDERWSLSRRRGRNLFVVLAHEIGHTLGLTHSPAPRALMAPYYKRLGRDALLSWDDVLAVQSLYGKPLGGSVAVQLPGKLFTDFETWDSYSPQGRRPETQGPKYCHSSFDAITVDRQQQLYIFKGSHFWEVAADGNVSEPRPLQERWVGLPPNIEAAAVSLNDGDFYFFKGGRCWRFRGPKPVWGLPQLCRAGGLPRHPDAALFFPPLRRLILFKGARYYVLARGGLQVEPYYPRSLQDWGGIPEEVSGALPRPDGSIIFFRDDRYWRLDQAKLQATTSGRWATELPWMGCWHANSGSALF

SEQ ID NO: 59 - protein, 2549 aa, Homo sapiens
MLGTGPAAATTAATTSSNVSVLQQFASGLKSRNEETRAKAAKELQHYVTMELREMSQEESTRFYDQLNHHIFELVSSSDANERKGGILAIASLIGVEGGNATRIGRFANYLRNLLPSNDPVVMEMASKAIGRLAMAGDTFTAEYVEFEVKRALEWLGADRNEGRRHAAVLVLRELAISVPTFFFQQVQPFFDNIFVAVWDPKQAIREGAVAALRACLILTTQREPKEMQKPQWYRHTFEEAEKGFDETLAKEKGMNRDDRIHGALLILNELVRISSMEGERLREEMEEITQQQLVHDKYCKDLMGFGTKPRHITPFTSFQAVQPQQSNALVGLLGYSSHQGLMGFGTSPSPAKSTLVESRCCRDLMEEKFDQVCQWVLKCRNSKNSLIQMTILNLLPRLAAFRPSAFTDTQYLQDTMNHVLSCVKKEKERTAAFQALGLLSVAVRSEFKVYLPRVLDIIRAALPPKDFAHKRQKAMQVDATVFTCISMLARAMGPGIQQDIKELLEPMLAVGLSPALTAVLYDLSRQIPQLKKDIQDGLLKMLSLVLMHKPLRHPGMPKGLAHQLASPGLTTLPEASDVGSITLALRTLGSFEFEGHSLTQFVRHCADHFLNSEHKEIRMEAARTCSRLLTPSIHLISGHAHVVSQTAVQVVADVLSKLLVVGITDPDPDIRYCVLASLDERFDAHLAQAENLQALFVALNDQVFEIRELAICTVGRLSSMNPAFVMPFLRKMLIQILTELEHSGIGRIKEQSARMLGHLVSNAPRLIRPYMEPILKALILKLKDPDPDPNPGVINNVLATIGELAQVSGLEMRKWVDELFIIIMDMLQDSSLLAKRQVALWTLGQLVASTGYVVEPYRKYPTLLEVLLNFLKTEQNQGTRREAIRVLGLLGALDPYKHKVNIGMIDQSRDASAVSLSESKSSQDSSDYSTSEMLVNMGNLPLDEFYPAVSMVALMRIFRDQSLSHHHTMVVQAITFIFKSLGLKCVQFLPQVMPTFLNVIRVCDGAIREFLFQQLGMLVSFVKSHIRPYMDEIVTLMREFWVMNTSIQSTIILLIEQIVVALGGEFKLYLPQLIPHMLRVFMHDNSPGRIVSIKLLAAIQLFGANLDDYLHLLLPPIVKLFDAPEAPLPSRKAALETVDRLTESLDFTDYASRIIHPIVRTLDQSPELRSTAMDTLSSLVFQLGKKYQIFIPMVNKVLVRHRINHQRYDVLICRIVKGYTLADEEEDPLIYQHRMLRSGQGDALASGPVETGPMKKLHVSTINLQKAWGAARRVSKDDWLEWLRRLSLELLKDSSSPSLRSCWALAQAYNPMARDLFNAAFVSCWSELNEDQQDELIRSIELALTSQDIAEVTQTLLNLAEFMEHSDKGPLPLRDDNGIVLLGERAAKCRAYAKALHYKELEFQKGPTPAILESLISINNKLQQPEAAAGVLEYAMKHFGELEIQATWYEKLHEWEDALVAYDKKMDTNKDDPELMLGRMRCLEALGEWGQLHQQCCEKWTLVNDETQAKMARMAAAAAWGLGQWDSMEEYTCMIPRDTHDGAFYRAVLALHQDLFSLAQQCIDKARDLLDAELTAMAGESYSRAYGAMVSCHMLSELEEVIQYKLVPERREIIRQIWWERLQGCQRIVEDWQKILMVRSLVVSPHEDMRTWLKYASLCGKSGRLALAHKTLVLLLGVDPSRQLDHPLPTVHPQVTYAYMKNMWKSARKIDAFQHMQHFVQTMQQQAQHAIATEDQQHKQELHKLMARCFLKLGEWQLNLQGINESTIPKVLQYYSAATEHDRSWYKAWHAWAVMNFEAVLHYKHQNQARDEKKKLRHASGANITNATTAATTAATATTTASTEGSNSESEAESTENSPTPSPLQKKVTEDLSKTLLMYTVPAVQGFFRSISLSRGNNLQDTLRVLTLWFDYGHWPDVNEALVEGVKAIQIDTWLQVIPQLIARIDTPRPLVGRLIHQLLTDIGRYHPQALIYPLTVASKSTTTARHNAANKILKNMCEHSNTLVQQAMMVSEELIRVAILWHEMWHEGLEEASRLYFGERNVKGMFEVLEPLHAMMERGPQTLKETSFNQAYGRDLMEAQEWCRKYMKSGNVKDLTQAWDLYYHVFRRISKQLPQLTSLELQYVSPKLLMCRDLELAVPGTYDPNQPIIRIQSIAPSLQVITSKQRPRKLTLMGSNGHEFVFLLKGHEDLRQDERVMQLFGLVNTLLANDPTSLRKNLSIQRYAVIPLSTNSGLIGWVPHCDTLHALIRDYREKKKILLNIEHRIMLRMAPDYDHLTLMQKVEVFEHAVNNTAGDDLAKLLWLKSPSSEVWFDRRTNYTRSLAVMSMVGYILGLGDRHPSNLMLDRLSGKILHIDFGDCFEVAMTREKFPEKIPFRLTRMLTNAMEVTGLDGNYRITCHTVMEVLREHKDSVMAVLEAFVYDPLLNWRLMDTNTKGNKRSRTRTDSYSAGQSVEILDGVELGEPAHKKTGTTVPESIHSFIGDGLVKPEALNKKAIQIINRVRDKLTGRDFSHDDTLDVPTQVELLIKQATSHENLCQCYIGWCPFW

SEQ ID NO: 60 - protein, 477 aa, Homo sapiens
MLGVRCLLRSVRFCSSAPFPKHKPSAKLSVRDALGAQNASGERIKIQGWIRSVRSQKEVLFLHVNDGSSLESLQVVADSGLDSRELNFGSSVEVQGQLIKSPSKRQNVELKAEKIKVIGNCDAKDFPIKYKERHPLEYLRQYPHFRCRTNVLGSILRIRSEATAAIHSFFKDSGFVHIHTPIITSNDSEGAGELFQLEPSGKLKVPEENFFNVPAFLTVSGQLHLEVMSGAFTQVFTFGPTFRAENSQSRRHLAEFYMIEAEISFVDSLQDLMQVIEELFKATTMMVLSKCPEDVELCHKFIAPGQKDRLEHMLKNNFLIISYTEAVEILKQASQNFTFTPEWGADLRTEHEKYLVKHCGNIPVFVINYPLTLKPFYMRDNEDGPQHTVAAVDLLVPGVGELFGGGLREERYHFLEERLARSGLTEVYQWYLDLRRFGSVPHGGFGMGFERYLQCILGVDNIKDVIPFPRFPHSCLL

SEQ ID NO: 61 - protein, 397 aa, Homo sapiens
MNCISDFFTYETTKSVVVKSWTIGIINRVVQLLIISYFVGWVFLHEKAYQVRDTAIESSVVTKVKGSGLYANRVMDVSDYVTPPQGTSVFVIITKMIVTENQMQGFCPESEEKYRCVSDSQCGPERLPGGGILTGRCVNYSSVLRTCEIQGWCPTEVDTVETPIMMEAENFTIFIKNSIRFPLFNFEKGNLLPNLTARDMKTCRFHPDKDPFCPILRVGDVVKFAGQDFAKLARTGGVLGIKIGWVCDLDKAWDQCIPKYSFTRLDSVSEKSSVSPGYNFRFAKYYKMENGSEYRTLLKAFGIRFDVLVYGNAGKFNIIPTIISSVAAFTSVGVGTVLCDIILLNFLKGADQYKAKKFEEVNETTLKIAALTNPVYPSDQTTAEKQSTDSGAFSIGH

SEQ ID NO: 62 - protein, 359 aa, Homo sapiens
MAAVSGLVRRPLREVSGLLKRRFHWTAPAALQVTVRDAINQGMDEELERDEKVFLLGEEVAQYDGAYKVSRGLWKKYGDKRIIDTPISEMGFAGIAVGAAMAGLRPICEFMTFNFSMQAIDQVINSAAKTYYMSGGLQPVPIVFRGPNGASAGVAAQHSQCFAAWYGHCPGLKVVSPWNSEDAKGLIKSAIRDNNPVVVLENELMYGVPFEFPPEAQSKDFLIPIGKAKIERQGTHITVVSHSRPVGHCLEAAAVLSKEGVECEVINMRTIRPMDMETIEASVMKTNHLVTVEGGWPQFGVGAEICARIMEGPAFNFLDAPAVRVTGADVPMPYAKILEDNSIPQVKDIIFAIKKTLNI

SEQ ID NO: 63 - protein, 1338 aa, Homo sapiens
MSPVLHFYVRPSGHEGAAPGHTRRKLQGKLPELQGVETELCYNVNWTAEALPSAEETKKLMWLFGCPLLLDDVARESWLLPGSNDLLLEVGPRLNFSTPTSTNIVSVCRATGLGPVDRVETTRRYRLSFAHPPSAEVEAIALATLHDRMTEQHFPHPIQSFSPESMPEPLNGPINILGEGRLALEKANQELGLALDSWDLDFYTKRFQELQRNPSTVEAFDLAQSNSEHSRHWFFKGQLHVDGQKLVHSLFESIMSTQESSNPNNVLKFCDNSSAIQGKEVRFLRPEDPTRPSRFQQQQGLRHVVFTAETHNFPTGVCPFSGATTGTGGRIRDVQCTGRGAHVVAGTAGYCFGNLHIPGYNLPWEDPSFQYPGNFARPLEVAIEASNGASDYGNKFGEPVLAGFARSLGLQLPDGQRREWIKPIMFSGGIGSMEADHISKEAPEPGMEVVKVGGPVYRIGVGGGAASSVQVQGDNTSDLDFGAVQRGDPEMEQKMNRVIRACVEAPKGNPICSLHDQGAGGNGNVLKELSDPAGAIIYTSRFQLGDPTLNALEIWGAEYQESNALLLRSPNRDFLTHVSARERCPACFVGTITGDRRIVLVDDRECPVRRNGQGDAPPTPLPTPVDLELEWVLGKMPRKEFFLQRKPPMLQPLALPPGLSVHQALERVLRLPAVASKRYLTNKVDRSVGGLVAQQQCVGPLQTPLADVAVVALSHEELIGAATALGEQPVKSLLDPKVAARLAVAEALTNLVFALVTDLRDVKCSGNWMWAAKLPGEGAALADACEAMVAVMAALGVAVDGGKDSLSMAARVGTETVRAPGSLVISAYAVCPDITATVTPDLKHPEGRGHLLYVALSPGQHRLGGTALAQCFSQLGEHPPDLDLPENLVRAFSITQGLLKDRLLCSGHDVSDGGLVTCLLEMAFAGNCGLQVDVPVPRVDVLSVLFAEEPGLVLEVQEPDLAQVLKRYRDAGLHCLELGHTGEAGPHAMVRVSVNGAVVLEEPVGELRALWEETSFQLDRLQAEPRCVAEEERGLRERMGPSYCLPPTFPKASVPREPGGPSPRVAILREEGSNGDREMADAFHLAGFEVWDVTMQDLCSGAIGLDTFRGVAFVGGFSYADVLGSAKGWAAAVTFHPRAGAELRRFRKRPDTFSLGVCNGCQLLALLGWVGGDPNEDAAEMGPDSQPARPGLLLRHNLSGRYESRWASVRVGPGPALMLRGMEGAVLPVWSAHGEGYVAFSSPELQAQIEARGLAPLHWADDDGNPTEQYPLNPNGSPGGVAGICSCDGRHLAVMPHPERAVRPWQWAWRPPPFDTLTTSPWLQLFINARNWTLEGSC

SEQ ID NO: 64 - protein, 483 aa, Homo sapiens
MAQADIALIGLAVMGQNLILNMNDHGFVVCAFNRTVSKVDDFLANEAKGTKVVGAQSLKEMVSKLKKPRRIILLVKAGQAVDDFIEKLVPLLDTGDIIIDGGNSEYRDTTRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQAFEDWNKTELDSFLIEITANILKFQDTDGKHLLPKIRDSAGQKGTGKWTAISALEYGVPVTLIGEAVFARCLSSLKDERIQASKKLKGPQKFQFDGDKKSFLEDIRKALYASKIISYAQGFMLLRQAATEFGWTLNYGGIALMWRGGCIIRSVFLGKIKDAFDRNPELQNLLLDDFFKSAVENCQDSWRRAVSTGVQAGIPMPCFTTALSFYDGYRHEMLPASLIQAQRDYFGAHTYELLAKPGQFIHTNWTGHGGTVSSSSYNA

SEQ ID NO: 65 - protein, 321 aa, Homo sapiens
MAAAEAGGDDARCVRLSAERAQALLADVDTLLFDCDGVLWRGETAVPGAPEALRALRARGKRLGFITNNSSKTRAAYAEKLRRLGFGGPAGPGASLEVFGTAYCTALYLRQRLAGAPAPKAYVLGSPALAAELEAVGVASVGVGPEPLQGEGPGDWLHAPLEPDVRAVVVGFDPHFSYMKLTKALRYLQQPGCLLVGTNMDNRLPLENGRFIAGTGCLVRAVEMAAQRQADIIGKPSRFIFDCVSQEYGINPERTVMVGDRLDTDILLGATCGLKTILTLTGVSTLGDVKNNQESDCVSKKKMVPDFYVDSIADLLPALQG

SEQ ID NO: 66 - protein, 2102 aa, Homo sapiens
MAAAPARGGGGGGGGGGGCSGSGSSASRGFYFNTVLSLARSLAVQRPASLEKVQKLLCMCPVDFHGIFQLDERRRDAVIALGIFLIESDLQHKDCVVPYLLRLLKGLPKVYWVEESTARKGRGALPVAESFSFCLVTLLSDVAYRDPSLRDEILEVLLQVLHVLLGMCQALEIQDKEYLCKYAIPCLIGISRAFGRYSNMEESLLSKLFPKIPPHSLRVLEELEGVRRRSFNDFRSILPSNLLTVCQEGTLKRKTSSVSSISQVSPERGMPPPSSPGGSAFHYFEASCLPDGTALEPEYYFSTISSSFSVSPLFNGVTYKEFNIPLEMLRELLNLVKKIVEEAVLKSLDAIVASVMEANPSADLYYTSFSDPLYLTMFKMLRDTLYYMKDLPTSFVKEIHDFVLEQFNTSQGELQKILHDADRIHNELSPLKLRCQANAACVDLMVWAVKDEQGAENLCIKLSEKLQSKTSSKVIIAHLPLLICCLQGLGRLCERFPVVVHSVTPSLRDFLVIPSPVLVKLYKYHSQYHTVAGNDIKISVTNEHSESTLNVMSGKKSQPSMYEQLRDIAIDNICRCLKAGLTVDPVIVEAFLASLSNRLYISQESDKDAHLIPDHTIRALGHIAVALRDTPKVMEPILQILQQKFCQPPSPLDVLIIDQLGCLVITGNQYIYQEVWNLFQQISVKASSVVYSATKDYKDHGYRHCSLAVINALANIAANIQDEHLVDELLMNLLELFVQLGLEGKRASERASEKGPALKASSSAGNLGVLIPVIAVLTRRLPPIKEAKPRLQKLFRDFWLYSVLMGFAVEGSGLWPEEWYEGVCEIATKSPLLTFPSKEPLRSVLQYNSAMKNDTVTPAELSELRSTIINLLDPPPEVSALINKLDFAMSTYLLSVYRLEYMRVLRSTDPDRFQVMFCYFEDKAIQKDKSGMMQCVIAVADKVFDAFLNMMADKAKTKENEEELERHAQFLLVNFNHIHKRIRRVADKYLSGLVDKFPHLLWSGTVLKTMLDILQTLSLSLSADIHKDQPYYDIPDAPYRITVPDTYEARESIVKDFAARCGMILQEAMKWAPTVTKSHLQEYLNKHQNWVSGLSQHTGLAMATESILHFAGYNKQNTTLGATQLSERPACVKKDYSNFMASLNLRNRYAGEVYGMIRFSGTTGQMSDLNKMMVQDLHSALDRSHPQHYTQAMFKLTAMLISSKDCDPQLLHHLCWGPLRMFNEHGMETALACWEWLLAGKDGVEVPFMREMAGAWHMTVEQKFGLFSAEIKEADPLAASEASQPKPCPPEVTPHYIWIDFLVQRFEIAKYCSSDQVEIFSSLLQRSMSLNIGGAKGSMNRHVAAIGPRFKLLTLGLSLLHADVVPNATIRNVLREKIYSTAFDYFSCPPKFPTQGEKRLREDISIMIKFWTAMFSDKKYLTASQLVPPDNQDTRSNLDITVGSRQQATQGWINTYPLSSGMSTISKKSGMSKKTNRGSQLHKYYMKRRTLLLSLLATEIERLITWYNPLSAPELELDQAGENSVANWRSKYISLSEKQWKDNVNLAWSISPYLAVQLPARFKNTEAIGNEVTRLVRLDPGAVSDVPEAIKFLVTWHTIDADAPELSHVLCWAPTDPPTGLSYFSSMYPPHPLTAQYGVKVLRSFPPDAILFYIPQIVQALRYDKMGYVREYILWAASKSQLLAHQFIWNMKTNIYLDEEGHQKDPDIGDLLDQLVEEITGSLSGPAKDFYQREFDFFNKITNVSAIIKPYPKGDERKKACLSALSEVKVQPGCYLPSNPEAIVLDIDYKSGTPMQSAAKAPYLAKFKVKRCGVSELEKEGLRCRSDSEDECSTQEADGQKISWQAAIFKVGDDCRQDMLALQIIDLFKNIFQLVGLDLFVFPYRVVATAPGCGVIECIPDCTSRDQLGRQTDFGMYDYFTRQYGDESTLAFQQARYNFIRSMAAYSLLLFLLQIKDRHNGNIMLDKKGHIIHIDFGFMFESSPGGNLGWEPDIKLTDEMVMIMGGKMEATPFKWFMEMCVRGYLAVRPYMDAVVSLVTLMLDTGLPCFRGQTIKLLKHRFSPNMTEREAANFIMKVIQSCFLSNRSRTYDMIQYYQNDIPY

SEQ ID NO: 67 - protein, 816 aa, Homo sapiens
MGDTVVEPAPLKPTSEPTSGPPGNNGGSLLSVITEGVGELSVIDPEVAQKACQEVLEKVKLLHGGVAVSSRGTPLELVNGDGVDSEIRCLDDPPAQIREEEDEMGAAVASGTAKGARRRRQNNSAKQSWLLRLFESKLFDISMAISYLYNSKEPGVQAYIGNRLFCFRNEDVDFYLPQLLNMYIHMDEDVGDAIKPYIVHRCRQSINFSLQCALLLGAYSSDMHISTQRHSRGTKLRKLILSDELKPAHRKRELPSLSPAPDTGLSPSKRTHQRSKSDATASISLSSNLKRTASNPKVENEDEELSSSTESIDNSFSSPVRLAPEREFIKSLMAIGKRLATLPTKEQKTQRLISELSLLNHKLPARVWLPTAGFDHHVVRVPHTQAVVLNSKDKAPYLIYVEVLECENFDTTSVPARIPENRIRSTRSVENLPECGITHEQRAGSFSTVPNYDNDDEAWSVDDIGELQVELPEVHTNSCDNISQFSVDSITSQESKEPVFIAAGDIRRRLSEQLAHTPTAFKRDPEDPSAVALKEPWQEKVRRIREGSPYGHLPNWRLLSVIVKCGDDLRQELLAFQVLKQLQSIWEQERVPLWIKPYKILVISADSGMIEPVVNAVSIHQVKKQSQLSLLDYFLQEHGSYTTEAFLSAQRNFVQSCAGYCLVCYLLQVKDRHNGNILLDAEGHIIHIDFGFILSSSPRNLGFETSAFKLTTEFVDVMGGLDGDMFNYYKMLMLQGLIAARKHMDKVVQIVEIMQQGSQLPCFHGSSTIRNLKERFHMSMTEEQLQLLVEQMVDGSMRSITTKLYDGFQYLTNGIM

SEQ ID NO: 68 - protein, 1358 aa, Homo sapiens
MGNQLAGIAPSQILSVESYFSDIHDFEYDKSLGSTRFFKVARAKHREGLVVVKVFAIQDPTLPLTSYKQELEELKIRLNSAQNCLPFQKASEKASEKAAMLFRQYVRDNLYDRISTRPFLNNIEKRWIAFQILTAVDQAHKSGVRHGDIKTENVMVTSWNWVLLTDFASFKPTYLPEDNPADFNYFFDTSRRRTCYIAPERFVDGGMFATELEYMRDPSTPLVDLNSNQRTRGELKRAMDIFSAGCVIAELFTEGVPLFDLSQLLAYRNGHFFPEQVLNKIEDHSIRELVTQMIHREPDKRLEAEDYLKQQRGNAFPEIFYTFLQPYMAQFAKETFLSADERILVIRKDLGNIIHNLCGHDLPEKAEGEPKENGLVILVSVITSCLQTLKYCDSKLAALELILHLAPRLSVEILLDRITPYLLHFSNDSVPRVRAEALRTLTKVLALVKEVPRNDINIYPEYILPGIAHLAQDDATIVRLAYAENIALLAETALRFLELVQLKNLNMENDPNNEEIDEVTHPNGNYDTELQALHEMVQQKVVTLLSDPENIVKQTLMENGITRLCVFFGRQKANDVLLSHMITFLNDKNDWHLRGAFFDSIVGVAAYVGWQSSSILKPLLQQGLSDAEEFVIVKALYALTCMCQLGLLQKPHVYEFASDIAPFLCHPNLWIRYGAVGFITVVARQISTADVYCKLMPYLDPYITQPIIQIERKLVLLSVLKEPVSRSIFDYALRSKDITSLFRHLHMRQKKRNGSLPDCPPPEDPAIAQLLKKLLSQGMTEEEEDKLLALKDFMMKSNKAKANIVDQSHLHDSSQKGVIDLAALGITGRQVDLVKTKQEPDDKRARKHVKQDSNVNEEWKSMFGSLDPPNMPQALPKGSDQEVIQTGKPPRSESSAGICVPLSTSSQVPEVTTVQNKKPVIPVLSSTILPSTYQIRITTCKTELQQLIQQKREQCNAERIAKQMMENAEWESKPPPPGWRPKGLLVAHLHEHKSAVNRIRVSDEHSLFATCSNDGTVKIWNSQKMEGKTTTTRSILTYSRIGGRVKTLTFCQGSHYLAIASDNGAVQLLGIEASKLPKSPKIHPLQSRILDQKEDGCVVDMHHFNSGAQSVLAYATVNGSLVGWDLRSSSNAWTLKHDLKSGLITSFAVDIHQCWLCIGTSSGTMACWDMRFQLPISSHCHPSRARIRRLSMHPLYQSWVIAAVQGNNEVSMWDMETGDRRFTLWASSAPPLSELQPSPHSVHGIYCSPADGNPILLTAGSDMKIRFWDLAYPERSYVVAGSTSSPSVSYYRKIIEGTEVVQEIQNKQKVGPSDDTPRRGPESLPVGHHDIITDVATFQTTQGFIVTASRDGIVKVWK

SEQ ID NO: 69 - protein, 326 aa, Homo sapiens
MLLSKFGSLAHLCGPGGVDHLPVKILQPAKADKESFEKAYQVGAVLGSGGFGTVYAGSRIADGLPVAVKHVVKERVTEWGSLGGATVPLEVVLLRKVGAAGGARGVIRLLDWFERPDGFLLVLERPEPAQDLFDFITERGALDEPLARRFFAQVLAAVRHCHSCGVVHRDIKDENLLVDLRSGELKLIDFGSGALLKDTVYTDFDGTRVYSPPEWIRYHRYHGRSATVWSLGVLLYDMVCGDIPFEQDEEILRGRLLFRRRVSPECQQLIRWCLSLRPSERPSLDQIAAHPWMLGADGGVPESCDLRLCTLDPDDVASTTSSSESL

SEQ ID NO: 70 - protein, 441 aa, Homo sapiens
MVPPKLHVLFCLCGCLAVVYPFDWQYINPVAHMKSSAWVNKIQVLMAAASFGQTKIPRGNGPYSVGCTDLMFDHTNKGTFLRLYYPSQDNDRLDTLWIPNKEYFWGLSKFLGTHWLMGNILRLLFGSMTTPANWNSPLRPGEKYPLVVFSHGLGAFRTLYSAIGIDLASHGFIVAAVEHRDRSASATYYFKDQSAAEIGDKSWLYLRTLKQEEETHIRNEQVRQRAKECSQALSLILDIDHGKPVKNALDLKFDMEQLKDSIDREKIAVIGHSFGGATVIQTLSEDQRFRCGIALDAWMFPLGDEVYSRIPQPLFFINSEYFQYPANIIKMKKCYSPDKERKMITIRGSVHQNFADFTFATGKIIGHMLKLKGDIDSNVAIDLSNKASLAFLQKHLGLHKDFDQWDCLIEGDDENLIPGTNINTTNQHIMLQNSSGIEKYN

SEQ ID NO: 71 - protein, 468 aa, Homo sapiens
MVDTESPLCPLSPLEAGDLESPLSEEFLQEMGNIQEISQSIGEDSSGSFGFTEYQYLGSCPGSDGSVITDTLSPASSPSSVTYPVVPGSVDESPSGALNIECRICGDKASGYHYGVHACEGCKGFFRRTIRLKLVYDKCDRSCKIQKKNRNKCQYCRFHKCLSVGMSHNAIRFGRMPRSEKAKLKAEILTCEHDIEDSETADLKSLAKRIYEAYLKNFNMNKVKARVILSGKASNNPPFVIHDMETLCMAEKTLVAKLVANGIQNKEAEVRIFHCCQCTSVETVTELTEFAKAIPGFANLDLNDQVTLLKYGVYEAIFAMLSSVMNKDGMLVAYGNGFITREFLKSLRKPFCDIMEPKFDFAMKFNALELDDSDISLFVAAIICCGDRPGLLNVGHIEKMQEGIVHVLRLHLQSNHPDDIFLFPKLLQKMADLRQLVTEHAQLVQIIKKTESDAALHPLLQEIYRDMY

SEQ ID NO: 72 - protein, 589 aa, Homo sapiens
MAAADGDDSLYPIAVLIDELRNEDVQLRLNSIKKLSTIALALGVERTRSELLPFLTDTIYDEDEVLLALAEQLGTFTTLVGGPEYVHCLLPPLESLATVEETVVRDKAVESLRAISHEHSPSDLEAHFVPLVKRLAGGDWFTSRTSACGLFSVCYPRVSSAVKAELRQYFRNLCSDDTPMVRRAAASKLGEFAKVLELDNVKSEIIPMFSNLASDEQDSVRLLAVEACVNIAQLLPQEDLEALVMPTLRQAAEDKSWRVRYMVADKFTELQKAVGPEITKTDLVPAFQNLMKDCEAEVRAAASHKVKEFCENLSADCRENVIMSQILPCIKELVSDANQHVKSALASVIMGLSPILGKDNTIEHLLPLFLAQLKDECPEVRLNIISNLDCVNEVIGIRQLSQSLLPAIVELAEDAKWRVRLAIIEYMPLLAGQLGVEFFDEKLNSLCMAWLVDHVYAIREAATSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSEVKPILEKLTQDQDVDVKYFAQEALTVLSLA

SEQ ID NO: 73 - protein, 671 aa, Homo sapiens
MADPAAGPPPSEGEESTVRFARKGALRQKNVHEVKNHKFTARFFKQPTFCSHCTDFIWGFGKQGFQCQVCCFVVHKRCHEFVTFSCPGADKGPASDDPRSKHKFKIHTYSSPTFCDHCGSLLYGLIHQGMKCDTCMMNVHKRCVMNVPSLCGTDHTERRGRIYIQAHIDRDVLIVLVRDAKNLVPMDPNGLSDPYVKLKLIPDPKSESKQKTKTIKCSLNPEWNETFRFQLKESDKDRRLSVEIWDWDLTSRNDFMGSLSFGISELQKASVDGWFKLLSQEEGEYFNVPVPPEGSEANEELRQKFERAKISQGTKVPEEKTTNTVSKFDNNGNRDRMKLTDFNFLMVLGKGSFGKVMLSERKGTDELYAVKILKKDVVIQDDDVECTMVEKRVLALPGKPPFLTQLHSCFQTMDRLYFVMEYVNGGDLMYHIQQVGRFKEPHAVFYAAEIAIGLFFLQSKGIIYRDLKLDNVMLDSEGHIKIADFGMCKENIWDGVTTKTFCGTPDYIAPEIIAYQPYGKSVDWWAFGVLLYEMLAGQAPFEGEDEDELFQSIMEHNVAYPKSMSKEAVAICKGLMTKHPGKRLGCGPEGERDIKEHAFFRYIDWEKLERKEIQPPYKPKARDKRDTSNFDKEFTRQPVELTPTDKLFIMNLDQNEFAGFSYTNPEFVINV

SEQ ID NO: 74 - protein, 637 aa, Homo sapiens
MAAMAVGGAGGSRVSSGRDLNCVPEIADTLGAVAKQGFDFLCMPVFHPRFKREFIQEPAKNRPGPQTRSDLLLSGRDWNTLIVGKLSPWIRPDSKVEKIRRNSEAAMLQELNFGAYLGLPAFLLPLNQEDNTNLARVLTNHIHTGHHSSMFWMRVPLVAPEDLRDDIIENAPTTHTEEYSGEEKTWMWWHNFRTLCDYSKRIAVALEIGADLPSNHVIDRWLGEPIKAAILPTSIFLTNKKGFPVLSKMHQRLIFRLLKLEVQFIITGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADRRIKLYAVEKNPNAVVTLENWQFEEWGSQVTVVSSDMREWVAPEKADIIVSELLGSFADNELSPECLDGAQHFLKDDGVSIPGEYTSFLAPISSSKLYNEVRACREKDRDPEAQFEMPYVVRLHNFHQLSAPQPCFTFSHPNRDPMIDNNRYCTLEFPVEVNTVLHGFAGYFETVLYQDITLSIRPETHSPGMFSWFPILFPIKQPITVREGQTICVRFWRCSNSKKVWYEWAVTAPVCSAIHNPTGRSYTIGL

SEQ ID NO: 75 - protein, 241 aa, Homo sapiens
MLSSTAMYSAPGRDLGMEPHRAAGPLQLRFSPYVFNGGTILAIAGEDFAIVASDTRLSEGFSIHTRDSPKCYKLTDKTVIGCSGFHGDCLTLTKIIEARLKMYKHSNNKAMTTGAIAAMLSTILYSRRFFPYYVYNIIGGLDEEGKGAVYSFDPVGSYQRDSFKAGGSASAMLQPLLDNQVGFKNMQNVEHVPLSLDRAMRLVKDVFISAAERDVYTGDALRICIVTKEGIREETVSLRKD

SEQ ID NO: 76 - protein, 264 aa, Homo sapiens
MEAFLGSRSGLWAGGPAPGQFYRIPSTPDSFMDPASALYRGPITRTQNPMVTGTSVLGVKFEGGVVIAADMLGSYGSLARFRNISRIMRVNNSTMLGASGDYADFQYLKQVLGQMVIDEELLGDGHSYSPRAIHSWLTRAMYSRRSKMNPLWNTMVIGGYADGESFLGYVDMLGVAYEAPSLATGYGAYLAQPLLREVLEKQPVLSQTEARDLVERCMRVLYYRDARSYNRFQIATVTEKGVEIEGPLSTETNWDIAHMISGFE

SEQ ID NO: 77 - protein, 239 aa, Homo sapiens
MAATLLAARGAGPAPAWGPEAFTPDWESREVSTGTTIMAVQFDGGVVLGADSRTTTGSYIANRVTDKLTPIHDRIFCCRSGSAADTQAVADAVTYQLGFHSIELNEPPLVHTAASLFKEMCYRYREDLMAGIIIAGWDPQEGGQVYSVPMGGMMVRQSFAIGGSGSSYIYGYVDATYREGMTKEECLQFTANALALAMERDGSSGGVIRLAAIAESGVERQVLLGDQIPKFAVATLPPA

SEQ ID NO: 78 - protein, 277 aa, Homo sapiens
MAAVSVYAPPVGGFSFDNCRRNAVLEADFAKRGYKLPKVRKTGTTIAGVVYKDGIVLGADTRATEGMVVADKNCSKIHFISPNIYCCGAGTAADTDMTTQLISSNLELHSLSTGRLPRVVTANRMLKQMLFRYQGYIGAALVLGGVDVTGPHLYSIYPHGSTDKLPYVTMGSGSLAAMAVFEDKFRPDMEEEEAKNLVSEAIAAGIFNDLGSGSNIDLCVISKNKLDFLRPYTVPNKKGTRLGRYRCEKGTTAVLTEKITPLEIEVLEETVQTMDTS

SEQ ID NO: 79 - protein, 111 aa, Homo sapiens
MSDAAVDTSSEITTKDLKEKKEVVEEAENGRDAPANGNAENEENGEQEADNEVDEEEEEGGEEEEEEEEGDGEEEDGDEDEEAESATGKRAAEDDEDDDVDTKKQKTDEDD

SEQ ID NO: 80 - protein, 435 aa, Homo sapiens
MEMEKEFEQIDKSGSWAAIYQDIRHEASDFPCRVAKLPKNKNRNRYRDVSPFDHSRIKLHQEDNDYINASLIKMEEAQRSYILTQGPLPNTCGHFWEMVWEQKSRGVVMLNRVMEKGSLKCAQYWPQKEEKEMIFEDTNLKLTLISEDIKSYYTVRQLELENLTTQETREILHFHYTTWPDFGVPESPASFLNFLFKVRESGSLSPEHGPVVVHCSAGIGRSGTFCLADTCLLLMDKRKDPSSVDIKKVLLEMRKFRMGLIQTADQLRFSYLAVIEGAKFIMGDSSVQDQWKELSHEDLEPPPEHIPPPPRPPKRILEPHNGKCREFFPNHQWVKEETQEDKDCPIKEEKGSPLNAAPYGIESMSQDTEVRSRVVGGSLRGAQAASPAKGEPSLPEKDEDHALSYWKPFLVNMCVATVLTAGAYLCYRFLFNSNT

SEQ ID NO: 81 - protein, 339 aa, Homo sapiens
MAMQMQLEANADTSVEEESFGPQPISRLEQCGINANDVKKLEEAGFHTVEAVAYAPKKELINIKGISEAKADKILAEAAKLVPMGFTTATEFHQRRSEIIQITTGSKELDKLLQGGIETGSITEMFGEFRTGKTQICHTLAVTCQLPIDRGGGEGKAMYIDTEGTFRPERLLAVAERYGLSGSDVLDNVAYARAFNTDHQTQLLYQASAMMVESRYALLIVDSATALYRTDYSGRGELSARQMHLARFLRMLLRLADEFGVAVVITNQVVAQVDGAAMFAADPKKPIGGNIIAHASTTRLYLRKGRGETRICKIYDSPCLPEAEAMFAINADGVGDAKD

SEQ ID NO: 82 - protein, 203 aa, Homo sapiens [sequence omitted]

SEQ ID NO: 83 - protein, 403 aa, Homo sapiens
MSHRKFSAPRHGSLGFLPRKRSSRHRGKVKSFPKDDPSKPVHLTAFLGYKAGMTHIVREVDRPGSKVNKKEVVEAVTIVETPPMVVVGIVGYVETPRGLRTFKTVFAEHISDECKRRFYKNWHKSKKKAFTKYCKKWQDEDGKKQLEKDFSSMKKYCQVIRVIAHTQMRLLPLRQKKAHLMEIQVNGGTVAEKLDWARERLEQQVPVNQVFGQDEMIDVIGVTKGKGYKGVTSRWHTKKLPRKTHRGLRKVACIGAWHPARVAFSVARAGQKGYHHRTEINKKIYKIGQGYLIKDGKLIKNNASTDYDLSDKSINPLGGFVHYGEVTNDFVMLKGCVVGTKKRVLTLRKSLLVQTKRRALEKIDLKFIDTTSKFGHGRFQTMEEKKAFMGPLKKDRIAKEEGA

SEQ ID NO: 84 - protein, 1335 aa, Homo sapiens
MESEMLQSPLLGLGEEDEADLTDWNLPLAFMKKRHCEKIEGSKSLAQSWRMKDRMKTVSVALVLCLNVGVDPPDVVKTTPCARLECWIDPLSMGPQKALETIGANLQKQYENWQPRARYKQSLDPTVDEVKKLCTSLRRNAKEERVLFHYNGHGVPRPTVNGEVWVFNKNYTQYIPLSIYDLQTWMGSPSIFVYDCSNAGLIVKSFKQFALQREQELEVAAINPNHPLAQMPLPPSMKNCIQLAACEATELLPMIPDLPADLFTSCLTTPIKIALRWFCMQKCVSLVPGVTLDLIEKIPGRLNDRRTPLGELNWIFTAITDTIAWNVLPRDLFQKLFRQDLLVASLFRNFLLAERIMRSYNCTPVSSPRLPPTYMHAMWQAWDLAVDICLSQLPTIIEEGTAFRHSPFFAEQLTAFQVWLTMGVENRNPPEQLPIVLQVLLSQVHRLRALDLLGRFLDLGPWAVSLALSVGIFPYVLKLLQSSARELRPLLVFIWAKILAVDSSCQADLVKDNGHKYFLSVLADPYMPAEHRTMTAFILAVIVNSYHTGQEACLQGNLIAICLEQLNDPHPLLRQWVAICLGRIWQNFDSARWCGVRDSAHEKLYSLLSDPIPEVRCAAVFALGTFVGNSAERTDHSTTIDHNVAMMLAQLVSDGSPMVRKELVVALSHLVVQYESNFCTVALQFIEEEKNYALPSPATTEGGSLTPVRDSPCTPRLRSVSSYGNIRAVATARSLNKSLQNLSLTEESGGAVAFSPGNLSTSSSASSTLGSPENEEHILSFETIDKMRRASSYSSLNSLIGVSFNSVYTQIWRVLLHLAADPYPEVSDVAMKVLNSIAYKATVNARPQRVLDTSSLTQSAPASPTNKGVHIHQAGGSPPASSTSSSSLTNDVAKQPVSRDLPSGRPGTTGPAGAQYTPHSHQFPRTRKMFDKGPEQTADDADDAAGHKSFISATVQTGFCDWSARYFAQPVMKIPEEHDLESQIRKEREWRFLRNSRVRRQAQQVIQKGITRLDDQIFLNRNPGVPSVVKFHPFTPCIAVADKDSICFWDWEKGEKLDYFHNGNPRYTRVTAMEYLNGQDCSLLLTATDDGAIRVWKNFADLEKNPEMVTAWQGLSDMLPTTRGAGMVVDWEQETGLLMSSGDVRIVRIWDTDREMKVQDIPTGADSCVTSLSCDSHRSLIVAGLGDGSIRVYDRRMALSECRVMTYREHTAWVVKASLQKRPDGHIVSVSVNGDVRIFDPRMPESVNVLQIVKGLTALDIHPQADLIACGSVNQFTAIYNSSGELINNIKYYDGFMGQRVGAISCLAFHPHWPHLAVGSNDYYISVYSVEKRVR

SEQ ID NO: 85 - protein, 792 aa, Homo sapiens
MHVIKRDGRQERVMFDKITSRIQKLCYGLNMDFVDPAQITMKVIQGLYSGVTTVELDTLAAETAATLTTKHPDYAILAARIAVSNLHKETKKVFSDVMEDLYNYINPHNGKHSPMVAKSTLDIVLANKDRLNSAIIYDRDFSYNYFGFKTLERSYLLKINGKVAERPQHMLMRVSVGIHKEDIDAAIETYNLLSERWFTHASPTLFNAGTNRPQLSSCFLLSMKDDSIEGIYDTLKQCALISKSAGGIGVAVSCIRATGSYIAGTNGNSNGLVPMLRVYNNTARYVDQGGNKRPGAFAIYLEPWHLDIFEFLDLKKNTGKEEQRARDLFFALWIPDLFMKRVETNQDWSLMCPNECPGLDEVWGEEFEKLYASYEKQGRVRKVVKAQQLWYAIIESQTETGTPYMLYKDSCNRKSNQQNLGTIKCSNLCTEIVEYTSKDEVAVCNLASLALNMYVTSEHTYDFKKLAEVTKVVVRNLNKIIDINYYPVPEACLSNKRHRPIGIGVQGLADAFILMRYPFESAEAQLLNKQIFETIYYGALEASCDLAKEQGPYETYEGSPVSKGILQYDMWNVTPTDLWDWKVLKEKIAKYGIRNSLLIAPMPTASTAQILGNNESIEPYTSNIYTRRVLSGEFQIVNPHLLKDLTERGLWHEEMKNQIIACNGSIQSIPEIPDDLKQLYKTVWEISQKTVLKMAAERGAFIDQSQSLNIHIAEPNYGKLTSMHFYGWKQGLKTGMYYLRTRPAANPIQFTLNKEKLKDKEKVSKEEEEKERNTAAMVCSLENRDECLMCGS

SEQ ID NO: 86 - protein, 98 aa, Homo sapiens
MMCSSLEQALAVLVTTFHKYSCQEGDKFKLSKGEMKELLHKELPSFVGEKVDEEGLKKLMGSLDENSDQQVDFQEYAVFLALITVMCNDFFQGCPDRP

SEQ ID NO: 87 - protein, 384 aa, Homo sapiens
MNATGTPVAPESCQQLAAGGHSRLIVLHYNHSGRLAGRGGPEDGGLGALRGLSVAASCLVVLENLLVLAAITSHMRSRRWVYYCLVNITLSDLLTGAAYLANVLLSGARTFRLAPAQWFLREGLLFTALAASTFSLLFTAGERFATMVRPVAESGATKTSRVYGFIGLCWLLAALLGMLPLLGWNCLCAFDRCSSLLPLYSKRYILFCLVIFAGVLATIMGLYGAIFRLVQASGQKAPRPAARRKARRLLKTVLMILLAFLVCWGPLFGLLLADVFGSNLWAQEYLRGMDWILALAVLNSAVNPIIYSFRSREVCRAVLSFLCCGCLRLGMRGPGDCLARAVEAHSGASTTDSSLRPRDSFRGSRSLSFRMREPLSSISSVRSI

SEQ ID NO: 88 - protein, 159 aa, Homo sapiens
MAVLWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGHWGLGQVVTDYVHGDALQKAAKAGLLALSALTFAGLCYFNYHDVGICKAVAMLWKL

SEQ ID NO: 89 - protein, 355 aa, Homo sapiens
MSVNYAAGLSPYADKGKCGLPEIFDPPEELERKVWELARLVWQSSSVVFHTGAGISTASGIPDFRGPHGVWTMEERGLAPKFDTTFESARPTQTHMALVQLERVGLLRFLVSQNVDGLHVRSGFPRDKLAELHGNMFVEECAKCKTQYVRDTVVGTMGLKATGRLCTVAKARGLRACRGELRDTILDWEDSLPDRDLALADEASRNADLSITLGTSLQIRPSGNLPLATKRRGGRLVIVNLQPTKHDRHADLRIHGYVDEVMTRLMKHLGLEIPAWDGPRVLERALPPLPRPPTPKLEPKEESPTRINGSIPAGPKQEPCAQHNGSEPASPKRERPTSPAPHRPPKRVKAKAVPS

SEQ ID NO: 90 - protein, 400 aa, Homo sapiens
MAAGGLSRSERKAAERVRRLREEQQRERLRQVSRILRKAAAERSAEEGRLLAESADLVTELQGRSRRREGLKRRQEEVCDDPEELRGKVRELASAVRNAKYLVVYTGAGISTAASIPDYRGPNGVWTLLQKGRSVSAADLSEAEPTLTHMSITRLHEQKLVQHVVSQNCDGLHLRSGLPRTAISELHGNMYIEVCTSCVPNREYVRVFDVTERTALHRHQTGRTCHKCGTQLRDTIVHFGERGTLGQPLNWEAATEAASRADTILCLGSSLKVLKKYPRLWCMTKPPSRRPKLYIVNLQWTPKDDWAALKLHGKCDDVMRLLMAELGLEIPAYSRWQDPIFSLATPLRAGEEGSHSRKSLCRSREEAPPGDRGAPLSSAPILGGWFGRGCTKRTKRKKVT

SEQ ID NO: 91 - protein, 1235 aa, Homo sapiens
MSFFNFRKIFKLGSEKKKKQYEHVKRDLNPEDFWEIIGELGDGAFGKVYKAQNKETSVLAAAKVIDTKSEEELEDYMVEIDILASCDHPNIVKLLDAFYYENNLWILIEFCAGGAVDAVMLELERPLTESQIQVVCKQTLDALNYLHDNKIIHRDLKAGNILFTLDGDIKLADFGVSAKNTRTIQRRDSFIGTPYWMAPEVVMCETSKDRPYDYKADVWSLGITLIEMAEIEPPHHELNPMRVLLKIAKSEPPTLAQPSRWSSNFKDFLKKCLEKNVDARWTTSQLLQHPFVTVDSNKPIRELIAEAKAEVTEEVEDGKEEDEEEETENSLPIPASKRASSDLSIASSEEDKLSQNACILESVSEKTERSNSEDKLNSKILNEKPTTDEPEKAVEDINEHITDAQLEAMTELHDRTAVIKENEREKRPKLENLPDTEDQETVDINSVSEGKENNIMITLETNIEHNLKSEEEKDQEKQQMFENKLIKSEEIKDTILQTVDLVSQETGEKEANIQAVDSEVGLTKEDTQEKLGEDDKTQKDVISNTSDVIGTCEAADVAQKVDEDSAEDTQSNDGKEVVEVGQKLINKPMVGPEAGGTKEVPIKEIVEMNEIEEGKNKEQAINSSENIMDINEEPGTTEGEEITESSSTEEMEVRSVVADTDQKALGSEVQDASKVTTQIDKEKKEIPVSIKKEPEVTVVSQPTEPQPVLIPSININSDSGENKEEIGSLSKTETILPPESENPKENDNDSGTGSTADTSSIDLNLSISSFLSKTKDSGSISLQETRRQKKTLKKTRKFIVDGVEVSVTTSKIVTDSDSKTEELRFLRRQELRELRFLQKEEQRAQQQLNSKLQQQREQIFRRFEQEMMSKKRQYDQEIENLEKQQKQTIERLEQEHTNRLRDEAKRIKGEQEKELSKFQNMLKNRKKEVINEVEKAPKELRKELMKRRKEELAQSQHAQEQEFVQKQQQELDGSLKKIIQQQKAELANIERECLNNKQQLMRAREAAIWELEERHLQEKHQLLKQQLKDQYFMQRHQLLKRHEKETEQMQRYNQRLIEELKNRQTQERARLPKIQRSEAKTRMAMFKKSLRINSTATPDQDRDKIKQFAAQEEKRQKNERMAQHQKHENQMRDLQLQCEANVRELHQLQNEKCHLLVEHETQKLKELDEEHSQELKEWREKLRPRKKTLEEEFARKLQEQEVFFKMTGESECLNPSTQSRISKFYPIPSLHSTGS

SEQ ID NO: 92 - protein, 154 aa, Homo sapiens [sequence omitted]

SEQ ID NO: 93 - protein, 361 aa, Homo sapiens
MGNVLAASSPPAGPPPPPAPALVGLPPPPPSPPGFTLPPLGGSLGAGTSTSRSSERTPGAATASASGAAEDGACGCLPNPGTFEECHRKCKELFPIQMEGVKLTVNKGLSNHFQVNHTVALSTIGESNYHFGVTYVGTKQLSPTEAFPVLVGDMDNSGSLNAQVIHQLGPGLRSKMAIQTQQSKFVNWQVDGEYRGSDFTAAVTLGNPDVLVGSGILVAHYLQSITPCLALGGELVYHRRPGEEGTVMSLAGKYTLNNWLATVTLGQAGMHATYYHKASDQLQVGVEFEASTRMQDTSVSFGYQLDLPKANLLFKGSVDSNWIVGATLEKKLPPLPLTLALGAFLNHRKNKFQCGFGLTIG

SEQ ID NO: 94 - protein, 286 aa, Homo sapiens
MAEDGEEAEFHFAALYISGQWPRLRADTDLQRLGSSAMAPSRKFFVGGNWKMNGRKQSLGELIGTLNAAKVPADTEVVCAPPTAYIDFARQKLDPKIAVAAQNCYKVTNGAFTGEISPGMIKDCGATWVVLGHSERRHVFGESDELIGQKVAHALAEGLGVIACIGEKLDEREAGITEKVVFEQTKVIADNVKDWSKVVLAYEPVWAIGTGKTATPQQAQEVHEKLRGWLKSNVSDAVAQSTRIIYGGSVTGATCKELASQPDVDGFLVGGASLKPEFVDIINAKQ

SEQ ID NO: 95 - protein, 180 aa, Homo sapiens
MSRQANRGTESKKMSSELFTLTYGALVTQLCKDYENDEDVNKQLDKMGFNIGVRLIEDFLARSNVGRCHDFRETADVIAKVAFKMYLGITPSITNWSPAGDEFSLILENNPLVDFVELPDNHSSLIYSNLLCGVLRGALEMVQMAVEAKFVQDTLKGDGVTEIRMRFIRRIEDNLPAGEE

SEQ ID NO: 96 - protein, 444 aa, Homo sapiens
MREIVHLQAGQCGNQIGAKFWEVISDEHGIDPTGTYHGDSDLQLERINVYYNEATGGNYVPRAVLVDLEPGTMDSVRSGPFGQIFRPDNFVFGQSGAGNNWAKGHYTEGAELVDAVLDVVRKEAESCDCLQGFQLTHSLGGGTGSGMGTLLISKIREEFPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQMFDAKNMMAACDPRHGRYLTVAAVFRGRMSMKEVDEQMLSVQSKNSSYFVEWIPNNVKTAVCDIPPRGLKMAATFIGNSTAIQELFKRISEQFTAMFRRKAFLHWYTGEGMDEMEFTEAESNMNDLVSEYQQYQDATAEEGEFEEEAEEEVA

SEQ ID NO: 97 - protein, 313 aa, Homo sapiens
MPVAGSELPRRPLPPAAQERDAEPRPPHGELQYLGQIQHILRCGVRKDDRTGTGTLSVFGMQARYSLRDEFPLLTTKRVFWKGVLEELLWFIKGSTNAKELSSKGVKIWDANGSRDFLDSLGFSTREEGDLGPVYGFQWRHFGAEYRDMESDYSGQGVDQLQRVIDTIKTNPDDRRIIMCAWNPRDLPLMALPPCHALCQFYVVNSELSCQLYQRSGDMGLGVPFNIASYALLTYMIAHITGLKPGDFIHTLGDAHIYLNHIEPLKIQLQREPRPFPKLRILRKVEKIDDFKAEDFQIEGYNPHPTIKMEMAV

SEQ ID NO: 98 - protein, 463 aa, Homo sapiens
MADGEEPEKKRRRIEELLAEKMAVDGGCGDTGDWEGRWNHVKKFLERSGPFTHPDFEPSTESLQFLLDTCKVLVIGAGGLGCELLKNLALSGFRQIHVIDMDTIDVSNLNRQFLFRPKDIGRPKAEVAAEFLNDRVPNCNVVPHFNKIQDFNDTFYRQFHIIVCGLDSIIARRWINGMLISLLNYEDGVLDPSSIVPLIDGGTEGFKGNARVILPGMTACIECTLELYPPQVNFPMCTIASMPRLPEHCIEYVRMLQWPKEQPFGEGVPLDGDDPEHIQWIFQKSLERASQYNIRGVTYRLTQGVVKRIIPAVASTNAVIAAVCATEVFKIATSAYIPLNNYLVFNDVDGLYTYTFEAERKENCPACSQLPQNIQFSPSAKLQEVLDYLTNSASLQMKSPAITATLEGKNRTLYLQSVTSIEERTRPNLSKTLKELGLVDGQELAVADVTTPQTVLFKLHFTS

SEQ ID NO: 99 - protein, 111 aa, Homo sapiens
MAGKQAVSASGKWLDGIRKWYYNAAGFNKLGLMRDDTIYEDEDVKEAIRRLPENLYNDRMFRIKRALDLNLKHQILPKEQWTKYEEENFYLEPYLKEVIRERKEREEWAKK

SEQ ID NO: 100 - protein, 367 aa, Homo sapiens
MEANGLGPQGFPELKNDTFLRAAWGEETDYTPVWCMRQAGRYLPEFRETRAAQDFFSTCRSPEACCELTLQPLRRFPLDAAIIFSDILVVPQALGMEVTMVPGKGPSFPEPLREEQDLERLRDPEVVASELGYVFQAITLTRQRLAGRVPLIGFAGAPWTLMTYMVEGGGSSTMAQAKRWLYQRPQASHQLLRILTDALVPYLVGQVVAGAQALQLFESHAGHLGPQLFNKFALPYIRDVAKQVKARLREAGLAPVPMIIFAKDGHFALEELAQAGYEVVGLDWTVAPKKARECVGKTVTLQGNLDPCALYASEEEIGQLVKQMLDDFGPHRYIANLGHGLYPDMDPEHVGAFVDAVHKHSRLLRQN

SEQ ID NO: 101 - protein, 858 aa, Homo sapiens
MAELSEEALLSVLPTIRVPKAGDRVHKDECAFSFDTPESEGGLYICMNTFLGFGKQYVERHFNKTGQRVYLHLRRTRRPKEEDPATGTGDPPRKKPTRLAIGVEGGFDLSEEKFELDEDVKIVILPDYLEIARDGLGGLPDIVRDRVTSAVEALLSADSASRKQEVQAWDGEVRQVSKHAFSLKQLDNPARIPPCGWKCSKCDMRENLWLNLTDGSILCGRRYFDGSGGNNHAVEHYRETGYPLAVKLGTITPDGADVYSYDEDDMVLDPSLAEHLSHFGIDMLKMQKTDKTMTELEIDMNQRIGEWELIQESGVPLKPLFGPGYTGIRNLGNSCYLNSVVQVLFSIPDFQRKYVDKLEKIFQNAPTDPTQDFSTQVAKLGHGLLSGEYSKPVPESGDGERVPEQKEVQDGIAPRMFKALIGKGHPEFSTNRQQDAQEFFLHLINMVERNCRSSENPNEVFRFLVEEKIKCLATEKVKYTQRVDYIMQLPVPMDAALNKEELLEYEEKKRQAEEEKMALPELVRAQVPFSSCLEAYGAPEQVDDFWSTALQAKSVAVKTTRFASFPDYLVIQIKKFTFGLDWVPKKLDVSIEMPEELDISQLRGTGLQPGEEELPDIAPPLVTPDEPKGSLGFYGNEDEDSFCSPHFSSPTSPMLDESVIIQLVEMGFPMDACRKAVYYTGNSGAEAAMNWVMSHMDDPDFANPLILPGSSGPGSTSAAADPPPEDCVTTIVSMGFSRDQALKALRATNNSLERAVDWIFSHIDDLDAEAAMDISEGRSAADSISESVPVGPKVRDGPGKYQLFAFISHMGTSTMCGHYVCHIKKEGRWVIYNDQKVCASEKPPKDLGYIYFYQRVAS

SEQ ID NO: 102 - protein, 806 aa, Homo sapiens
MASGADSKGDDLSTAILKQKNRPNRLIVDEAINEDNSVVSLSQPKMDELQLFRGDTVLLKGKKRREAVCIVLSDDTCSDEKIRMNRVVRNNLRVRLGDVISIQPCPDVKYGKRIHVLPIDDTVEGITGNLFEVYLKPYFLEAYRPIRKGDIFLVRGGMRAVEFKVVETDPSPYCIVAPDTVIHCEGEPIKREDEEESLNEVGYDDIGGCRKQLAQIKEMVELPLRHPALFKAIGVKPPRGILLYGPPGTGKTLIARAVANETGAFFFLINGPEIMSKLAGESESNLRKAFEEAEKNAPAIIFIDELDAIAPKREKTHGEVERRIVSQLLTLMDGLKQRAHVIVMAATNRPNSIDPALRRFGRFDREVDIGIPDATGRLEILQIHTKNMKLADDVDLEQVANETHGHVGADLAALCSEAALQAIRKKMDLIDLEDETIDAEVMNSLAVTMDDFRWALSQSNPSALRETVVEVPQVTWEDIGGLEDVKRELQELVQYPVEHPDKFLKFGMTPSKGVLFYGPPGCGKTLLAKAIANECQANFISIKGPELLTMWFGESEANVREIFDKARQAAPCVLFFDELDSIAKARGGNIGDGGGAADRVINQILTEMDGMSTKKNVFIIGATNRPDIIDPAILRPGRLDQLIYIPLPDEKSRVAILKANLRKSPVAKDVDLEFLAKMTNGFSGADLTEICQRACKLAIRESIESEIRRERERQTNPSAMEVEEDDPVPEIRRDHFEEAMRFARRSVSDNDIRKYEMFAQTLQQSRGFGSFRFPSGNQGGAGPSQGSGGGTGGSVYTEDNDDDLYG

SEQ ID NO: 103 - protein, 283 aa, Homo sapiens
MAVPPTYADLGKSARDVFTKGYGFGLIKLDLKTKSENGLEFTSSGSANTETTKVTGSLETKYRWTEYGLTFTEKWNTDNTLGTEITVEDQLARGLKLTFDSSFSPNTGKKNAKIKTGYKREHINLGCDMDFDIAGPSIRGALVLGYEGWLAGYQMNFETAKSRVTQSNFAVGYKTDEFQLHTNVNDGTEFGGSIYQKVNKKLETAVNLAWTAGNSNTRFGIAAKYQIDPDACFSAKVNNSSLIGLGYTQTLKPGIKLTLSALLDGKNVNAGGHKLGLGLEFQA

SEQ ID NO: 104 - protein, 471 aa, Homo sapiens
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQMTDDEKYLWKDLTLDQAYSYAVENAKDIIACGFDINKTFIFSDLDYMGMSSGFYKNVVKIQKHVTFNQVKGIFGFTDSDCIGKISFPAIQAAPSFSNSFPQIFRDRTDIQCLIPCAIDQDPYFRMTRDVAPRIGYPKPALLHSTFFPALQGAQTKMSASDPNSSIFLTDTAKQIKTKVNKHAFSGGRDTIEEHRQFGGNCDVDVSFMYLTFFLEDDDKLEQIRKDYTSGAMLTGELKKALIEVLQPLIAEHQARRKEVTDEIVKEFMTPRKLSFDFQ

SEQ ID NO: 105 - protein, 360 aa, Homo sapiens
MALHSMRKARERWSFIRALHKGSAAAPALQKDSKKRVFSGIQPTGILHLGNYLGAIESWVRLQDEYDSVLYSIVDLHSITVPQDPAVLRQSILDMTAVLLACGINPEKSILFQQSQVSEHTQLSWILSCMVRLPRLQHLHQWKAKTTKQKHDGTVGLLTYPVLQAADILLYKSTHVPVGEDQVQHMELVQDLAQGFNKKYGEFFPVPESILTSMKKVKSLRDPSAKMSKSDPDKLATVRITDSPEEIVQKFRKAVTDFTSEVTYDPAGRAGVSNIVAVHAAVTGLSVEEVVRRSAGMNTARYKLAVADAVIEKFAPIKREIEKLKLDKDHLEKVLQIGSAKAKELAYTVCQEVKKLVGFL

SEQ ID NO: 106 - protein, 346 aa, Homo sapiens
MDLDLLDLNPRIIAAIKKAKLKSVKEVLHFSGPDLKRLTNLSSPEVWHLLRTASLHLRGSSILTALQLHQQKERFPTQHQRLSLGCPVLDALLRGGLPLDGITELAGRSSAGKTQLALQLCLAVQFPRQHGGLEAGAVYICTEDAFPHKRLQQLMAQQPRLRTDVPGELLQKLRFGSQIFIEHVADVDTLLECVNKKVPVLLSRGMARLVVIDSVAAPFRCEFDSQASAPRARHLQSLGATLRELSSAFQSPVLCINQVTEAMEEQGAAHGPLGFWDERVSPALGITWANQLLVRLLADRLREEEAALGCPARTLRVLSAPHLPPSSCSYTISAEGVRGTPGTQSH

SEQ ID NO: 107 - protein, 153 aa, Homo sapiens
MARNVVYPLYRLGGPQLRVFRTNFFIQLVRPGVAQPEDTVQFRIPMEMTRVDLRNYLEGIYNVPVAAVRTRVQHGSNKRRDHRNVRIKKPDYKVAYVQLAHGQTFTFPDLFPEKDESPEGSAADDLYSMLEEERQQRQSSDPRRGGVPSWFGL

SEQ ID NO: 108 - protein, 145 aa, Homo sapiens [sequence omitted]

SEQ ID NO: 109 - protein, 135 aa, Homo sapiens [sequence omitted]

SEQ ID NO: 110 - protein, 110 aa, Homo sapiens [sequence omitted]

SEQ ID NO: 111 - protein, 106 aa, Homo sapiens
MVNVPKTRRTFCKKCGKHQPHKVTQYKKGKDSLYAQGRRRYDRKQSGYGGQTKPIFRKKAKTTKKIVLRLECVEPNCRSKRMLAIKRCKHFELGGDKKRKGQVIQF

SEQ ID NO: 112 - protein, 92 aa, Homo sapiens [sequence omitted]

SEQ ID NO: 113 - protein, 51 aa, Homo sapiens [sequence omitted]

SEQ ID NO: 114 - protein, 114 aa, Homo sapiens
MASVSELACIYSALILHDDEVTVTEDKINALIKAAGVNVEPFWPGLFAKALANVNIGSLICNVGAGGPAPAAGAAPAGGPAPSTAAAPAEEKKVEAKKEESEESDDDMGFGLFD

SEQ ID NO: 115 - protein, 198 aa, Homo sapiens [sequence omitted]

SEQ ID NO: 116 - protein, 249 aa, Homo sapiens
MKLNISFPATGCQKLIEVDDERKLRTFYEKRMATEVAADALGEEWKGYVVRISGGNDKQGFPMKQGVLTHGRVRLLLSKGHSCYRPRRTGERKRKSVRGCIVDANLSVLNLVIVKKGEKDIPGLTDTTVPRRLGPKRASRIRKLFNLSKEDDVRQYVVRKPLNKEGKKPRTKAPKIQRLVTPRVLQHKRRRIALKKQRTKKNKEEAAEYAKLLAKRMKEAKEKRQEQIAKRRRLSSLRASTSKSESSQK

SEQ ID NO: 117 - protein, 208 aa, Homo sapiens [sequence omitted]

SEQ ID NO: 118 - protein, 165 aa, Homo sapiens
MLMPKKNRIAIYELLFKEGVMVAKKDVHMPKHPELADKNVPNLHVMKAMQSLKSRGYVKEQFAWRHFYWYLTNEGIQYLRDYLHLPPEIVPATLRRSRPETGRPRPKGLEGERPARLTRGEADRDTYRRSAVPPGADKKAEAGAGSATEFQFRGGFGRGRGQPPQ

SEQ ID NO: 119 - protein, 132 aa, Homo sapiens [sequence omitted]

SEQ ID NO: 120 - protein, 130 aa, Homo sapiens [sequence omitted]

SEQ ID NO: 121 - protein, 145 aa, Homo sapiens [sequence omitted]

SEQ ID NO: 122 - protein, 83 aa, Homo sapiens
MQNDAGEFVDLYVPRKCSASNRIIGAKDHASIQMNVAEVDKVTGRFNGQFKTYAICGAIRRMGESDDSILRLAKADGIVSKNF

SEQ ID NO: 123 - protein, 125 aa, Homo sapiens [sequence omitted]

SEQ ID NO: 124 - protein, 69 aa, Homo sapiens [sequence omitted]

SEQ ID NO: 125 - protein, 125 aa, Homo sapiens [sequence omitted]

SEQ ID NO: 126 - protein, 87 aa, Homo sapiens
MAKHLKFIARTVMVQEGNVESAYRTLNRILTMDGLIEDIKHRRYYEKPCRRRQRESYERCRRIYNMEMARKINFLMRKNRADPWQGC

SEQ ID NO: 127 - protein, 149 aa, Homo sapiens
MVFLTAQLWLRNRVTDRYFRIQEVLKHARHFRGRKNRCYRLAVRTVIRAFVKCTKARYLKKKNMRTLWINRITAASQEHGLKYPALIGNLVKCQVELNRKVLADLAIYEPKTFKSLAALASRRRHEGFAAALGDGKEPEGIFSRVVQYH

SEQ ID NO: 128 - protein, 205 aa, Homo sapiens
MAASSLTVTLGRLASACSHSILRPSGPGAASLWSASRRFNSQSTSYLPGYVPKTSLSSPPWPEVVLPDPVEETRHHAEVVKKVNEMIVTGQYGRLFAVVHFASRQWKVTSEDLILIGNELDLACGERIRLEKVLLVGADNFTLLGKPLLGKDLVRVEATVIEKTESWPRIIMRFRKRKNFKKKRIVTTPQTVLRINSIEIAPCLL

SEQ ID NO: 129 - protein, 178 aa, Homo sapiens
MSSFSRAPQQWATFARIWYLLDGKMQPPGKLAAMASIRLQGLHKPVYHALSDCGDHVVIMNTRHIAFSGNKWEQKVYSSHTGYPGGFRQVTAAQLHLRDPVAIVKLAIYGMLPKNLHRRTMMERLHLFPDEYIPEDILKNLVEELPQPRKIPKRLDEYTQEEIDAFPRLWTPPEDYRL

SEQ ID NO: 130 - protein, 295 aa, Homo sapiens [sequence omitted]

SEQ ID NO: 131 - protein, 215 aa, Homo sapiens [sequence omitted]

SEQ ID NO: 132 - protein, 196 aa, Homo sapiens
MAALKALVSGCGRLLRGLLAGPAATSWSRLPARGFREVVETQEGKTTIIEGRITATPKESPNPPNPSGQCPICRWNLKHKYNYDDVLLLSQFIRPHGGMLPRKITGLCQEEHRKIEECVKMAHRAGLLPNHRPRLPEGVVPKSKPQLNRYLTRWAPGSVKPIYKKGPRWNRVRMPVGSPLLRDNVCYSRTPWKLYH

SEQ ID NO: 133 - protein, 311 aa, Homo sapiens [sequence omitted]

SEQ ID NO: 134 - protein, 103 aa, Homo sapiens [sequence omitted]

SEQ ID NO: 135 - protein, 297 aa, Homo sapiens [sequence omitted]

SEQ ID NO: 136 - protein, 248 aa, Homo sapiens
MEGVEEKKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVRKVLQLLRLRQIFNGTFVKLNKASINMLRIVEPYIAWGYPNLKSVNELIYKRGYGKINKKRIALTDNALIARSLGKYGIICMEDLIHEIYTVGKRFKEANNFLWPFKLSSPRGGMKKKTTHFVEGGDAGNREDQINRLIRRMN

SEQ ID NO: 137 - protein, 140 aa, Homo sapiens
MAENREPRGAVEAELDPVEYTLRKRLPSRLPRRPNDIYVNMKTDFKAQLARCQKLLDGGARGQNACSEIYIHGLGLAINRAINIALQLQAGSFGSLQVAANTSTVELVDELEPETDTREPLTRIRNNSAIHIRVFRVTPK

SEQ ID NO: 138 - protein, 360 aa, Homo sapiens
MFVARSIAADHKDLIHDVSFDFHGRRMATCSSDQSVKVWDKSESGDWHCTASWKTHSGSVWRVTWAHPEFGQVLASCSFDRTAAVWEEIVGESNDKLRGQSHWVKRTTLVDSRTSVTDVKFAPKHMGLMLATCSADGIVRIYEAPDVMNLSQWSLQHEISCKLSCSCISWNPSSSRAHSPMIAVGSDDSSPNAMAKVQIFEYNENTRKYAKAETLMTVTDPVHDIAFAPNLGRSFHILAIATKDVRIFTLKPVRKELTSSGGPTKFEIHIVAQFDNHNSQVWRVSWNITGTVLASSGDDGCVRLWKANYMDNWKCTGILKGNGSPVNGSSQQGTSNPSLGSTIPSLQNSLNGSSAGRKHS

SEQ ID NO: 139 - protein, 220 aa, Homo sapiens
MKSVIYHALSQKEANDSDVQPSGAQRAEAFVRAFLKRSTPRMSPQAREDQLQRKAVVLEYFTRHKRKEKKKKAKGLSARQRRELRLFDIKPEQQRYSLFLPLHELWKQYIRDLCSGLKPDTQPQMIQAKLLKADLHGAIISVTKSKCPSYVGITGILLQETKHIFKIITKEDRLKVIPKLNCVFTVETDGFISYIYGSKFQLRSSERSAKKFKAKGTIDL

SEQ ID NO: 140 - protein, 154 aa, Homo sapiens
MAGPVKDREAFQRLNFLYQAAHCVLAQDPENQALARFYCYTERTIAKRLVLRRDPSVKRTLCRGCSSLLVPGLTCTQRQRRCRGQRWTVQTCLTCQRSQRFLNDPGHLLWGDRPEAQLGSQADSKPLQPLPNTAHSISDRLPEEKMQTQGSSNQ

SEQ ID NO: 141 - protein, 790 aa, Homo sapiens
MSRRRHSDENDGGQPHKRRKTSDANETEDHLESLICKVGEKSACSLESNLEGLAGVLEADLPNYKSKILRLLCTVARLLPEKLTIYTTLVGLLNARNYNFGGEFVEAMIRQLKESLKANNYNEAVYLVRFLSDLVNCHVIAAPSMVAMFENFVSVTQEEDVPQVRRDWYVYAFLSSLPWVGKELYEKKDAEMDRIFANTESYLKRRQKTHVPMLQVWTADKPHPQEEYLDCLWAQIQKLKKDRWQERHILRPYLAFDSILCEALQHNLPPFTPPPHTEDSVYPMPRVIFRMFDYTDDPEGPVMPGSHSVERFVIEENLHCIIKSHWKERKTCAAQLVSYPGKNKIPLNYHIVEVIFAELFQLPAPPHIDVMYTTLLIELCKLQPGSLPQVLAQATEMLYMRLDTMNTTCVDRFINWFSHHLSNFQFRWSWEDWSDCLSQDPESPKPKFVREVLEKCMRLSYHQRILDIVPPTFSALCPANPTCIYKYGDESSNSLPGHSVALCLAVAFKSKATNDEIFSILKDVPNPNQDDDDDEGFSFNPLKIEVFVQTLLHLAAKSFSHSFSALAKFHEVFKTLAESDEGKLHVLRVMFEVWRNHPQMIAVLVDKMIRTQIVDCAAVANWIFSSELSRDFTRLFVWEILHSTIRKMNKHVLKIQKELEEAKEKLARQHKRRSDDDDRSSDRKDGVLEEQIERLQEKVESAQSEQKNLFLVIFQRFIMILTEHLVRCETDGTSVLTPWYKNCIERLQQIFLQHHQIIQQYMVTLENLLFTAELDPHILAVFQQFCALQA

SEQ ID NO: 142 - protein, 163 aa, Homo sapiens
MVRFKHRYLLCELVSDDPRCRLSLDDRVLSSLVRDTIARVHGTFGAAACSIGFAVRYLNAYTGIVLLRCRKEFYQLVWSALPFITYLENKGHRYPCFFNTLHVGGTIRTCQKFLIQYNRRQLLILLQNCTDEGEREAIQKSVTRSCLLEEEEESGEEAAEAME

SEQ ID NO: 143 - protein, 242 aa, Homo sapiens
MAAVKASTSKATRPWYSHPVYARYWQHYHQAMAWMQSHHNAYRKAVESCFNLPWYLPSALLPQSSYDNEAAYPQSFYDHHVAWQDYPCSSSHFRRSGQHPRYSSRIQASTKEDQALSKEEEMETESDAEVECDLSNMEITEELRQYFAETERHREERRRQQQLDAERLDSYVNADHDLYCNTRRSVEAPTERPGERRQAEMKRLYGDSAAKIQAMEAAVQLSFDKHCDRKQPKYWPVIPLKF

SEQ ID NO: 144 - protein, 1024 aa, Homo sapiens
MSNAKERKHAKKMRNQPTNVTLSSGFVADRGVKHHSGGEKPFQAQKQEPHPGTSRQRQTRVNPHSLPDPEVNEQSSSKGMFRKKGGWKAGPEGTSQEIPKYITASTFAQARAAEISAMLKAVTQKSSNSLVFQTLPRHMRRRAMSHNVKRLPRRLQEIAQKEAEKAVHQKKEHSKNKCHKARRCHMNRTLEFNRRQKKNIWLETHIWHAKRFHMVKKWGYCLGERPTVKSHRACYRAMTNRCLLQDLSYYCCLELKGKEEEILKALSGMCNIDTGLTFAAVHCLSGKRQGSLVLYRVNKYPREMLGPVTFIWKSQRTPGDPSESRQLWIWLHPTLKQDILEEIKAACQCVEPIKSAVCIADPLPTPSQEKSQTELPDEKIGKKRKRKDDGENAKPIKKIIGDGTRDPCLPYSWISPTTGIIISDLTMEMNRFRLIGPLSHSILTEAIKAASVHTVGEDTEETPHRWWIETCKKPDSVSLHCRQEAIFELLGGITSPAEIPAGTILGLTVGDPRINLPQKKSKALPNPEKCQDNEKVRQLLLEGVPVECTHSFIWNQDICKSVTENKISDQDLNRMRSELLVPGSQLILGPHESKIPILLIQQPGKVTGEDRLGWGSGWDVLLPKGWGMAFWIPFIYRGVRVGGLKESAVHSQYKRSPNVPGDFPDCPAGMLFAEEQAKNLLEKYKRRPPAKRPNYVKLGTLAPFCCPWEQLTQDWESRVQAYEEPSVASSPNGKESDLRRSEVPCAPMPKKTHQPSDEVGTSIEHPREAEEVMDAGCQESAGPERITDQEASENHVAATGSHLCVLRSRKLLKQLSAWCGPSSEDSRGGRRAPGRGQQGLTREACLSILGHFPRALVWVSLSLLSKGSPEPHTMICVPAKEDFLQLHEDWHYCGPQESKHSDPFRSKILKQKEKKKREKRQKPGRASSDGPAGEEPVAGQEALTLGLWSGPLPRVTLHCSRTLLGFVTQGDFSMAVGCGEALGFVSLTGLLDMLSSQPAAQRGLVLLRPPASLQYRFARIAIEV

SEQ ID NO: 145 - protein, 174 aa, Homo sapiens
MADVLDLHEAGGEDFAMDEDGDESIHKLKEKAKKRKGRGFGSEEGSRARMREDYDSVEQDGDEPGPQRSVEGWILFVTGVHEEATEEDIHDKFAEYGEIKNIHLNLDRRTGYLKGYTLVEYETYKEAQAAMEGLNGQDLMGQPISVDWCFVRGPPKGKRRGGRRRSRSPDRRRR

SEQ ID NO: 146 - protein, 1436 aa, Homo sapiens
MLHLSAAPPAPPPEVTATARPCLCSVGRRGDGGKMAAAGALERSFVELSGAERERPRHFREFTVCSIGTANAVAGAVKYSESAGGFYYVESGKLFSVTRNRFIHWKTSGDTLELMEESLDINLLNNAIRLKFQNCSVLPGGVYVSETQNRVIILMLTNQTVHRLLLPHPSRMYRSELVVDSQMQSIFTDIGKVDFTDPCNYQLIPAVPGISPNSTASTAWLSSDGEALFALPCASGGIFVLKLPPYDIPGMVSVVELKQSSVMQRLLTGWMPTAIRGDQSPSDRPLSLAVHCVEHDAFIFALCQDHKLRMWSYKEQMCLMVADMLEYVPVKKDLRLTAGTGHKLRLAYSPTMGLYLGIYMHAPKRGQFCIFQLVSTESNRYSLDHISSLFTSQETLIDFALTSTDIWALWHDAENQTVVKYINFEHNVAGQWNPVFMQPLPEEEIVIRDDQDPREMYLQSLFTPGQFTNEALCKALQIFCRGTERNLDLSWSELKKEVTLAVENELQGSVTEYEFSQEEFRNLQQEFWCKFYACCLQYQEALSHPLALHLNPHTNMVCLLKKGYLSFLIPSSLVDHLYLLPYENLLTEDETTISDDVDIARDVICLIKCLRLIEESVTVDMSVIMEMSCYNLQSPEKAAEQILEDMITIDVENVMEDICSKLQEIRNPIHAIGLLIREMDYETEVEMEKGFNPAQPLNIRMNLTQLYGSNTAGYIVCRGVHKIASTRFLICRDLLILQQLLMRLGDAVIWGTGQLFQAQQDLLHRTAPLLLSYYLIKWGSECLATDVPLDTLESNLQHLSVLELTDSGALMANRFVSSPQTIVELFFQEVARKHIISHLFSQPKAPLSQTGLNWPEMITAITSYLLQLLWPSNPGCLFLECLMGNCQYVQLQDYIQLLHPWCQVNVGSCRFMLGRCYLVTGEGQKALECFCQAASEVGKEEFLDRLIRSEDGEIVSTPRLQYYDKVLRLLDVIGLPELVIQLATSAITEAGDDWKSQATLRTCIFKHHLDLGHNSQAYEALTQIPDSSRQLDCLRQLVVVLCERSQLQDLVEFPYVNLHNEVVGIIESRARAVDLMTHNYYELLYAFHIYRHNYRKAGTVMFEYGMRLGREVRTLRGLEKQGNCYLAALNCLRLIRPEYAWIVQPVSGAVYDRPGASPKRNHDGECTAAPTNRQIEILELEDLEKECSLARIRLTLAQHDPSAVAVAGSSSAEEMVTLLVQAGLFDTAISLCQTFKLPLTPVFEGLAFKCIKLQFGGEAAQAEAWAWLAANQLSSVITTKESSATDEAWRLLSTYLERYKVQNNLYHHCVINKLLSHGVPLPNWLINSYKKVDAAELLRLYLNYDLLEEAVDLVSEYVDAVLGKGHQYFGIEFPLSATAPMVWLPYSSIDQLLQALGENSANSHNIALSQKILDKLEDYQQKVDKATRDLLYRRTL

SEQ ID NO: 147 - protein, 1475 aa, Homo sapiens
MASGAGGVGGGGGGKIRTRRCHQGPIKPYQQGRQQHQGILSRVTESVKNIVPGWLQRYFNKNEDVCSCSTDTSEVPRWPENKEDHLVYADEESSNITDGRITPEPAVSNTEEPSTTSTASNYPDVLTRPSLHRSHLNFSMLESPALHCQPSTSSAFPIGSSGFSLVKEIKDSTSQHDDDNISTTSGFSSRASDKDITVSKNTSLPPLWSPEAERSHSLSQHTATSSKKPAFNLSAFGTLSPSLGNSSILKTSQLGDSPFYPGKTTYGGAAAAVRQSKLRNTPYQAPVRRQMKAKQLSAQSYGVTSSTARRILQSLEKMSSPLADAKRIPSIVSSPLNSPLDRSGIDITDFQAKREKVDSQYPPVQRLMTPKPVSIATNRSVYFKPSLTPSGEFRKTNQRIDNKCSTGYEKNMTPGQNREQRESGFSYPNFSLPAANGLSSGVGGGGGKMRRERTRFVASKPLEEEEMEVPVLPKISLPITSSSLPTFNFSSPEITTSSPSPINSSQALTNKVQMTSPSSTGSPMFKFSSPIVKSTEANVLPPSSIGFTFSVPVAKTAELSGSSSTLEPIISSSAHHVTTVNSTNCKKTPPEDCEGPFRPAEILKEGSVLDILKSPGFASPKIDSVAAQPTATSPVVYTRPAISSFSSSGIGFGESLKAGSSWQCDTCLLQNKVTDNKCIACQAAKLSPRDTAKQTGIETPNKSGKTTLSASGTGFGDKFKPVIGTWDCDTCLVQNKPEAIKCVACETPKPGTCVKRALTLTVVSESAETMTASSSSCTVTTGTLGFGDKFKRPIGSWECSVCCVSNNAEDNKCVSCMSEKPGSSVPASSSSTVPVSLPSGGSLGLEKFKKPEGSWDCELCLVQNKADSTKCLACESAKPGTKSGFKGFDTSSSSSNSAASSSFKFGVSSSSSGPSQTLTSTGNFKFGDQGGFKIGVSSDSGSINPMSEGFKFSKPIGDFKFGVSSESKPEEVKKDSKNDNFKFGLSSGLSNPVSLTPFQFGVSNLGQEEKKEELPKSSSAGFSFGTGVINSTPAPANTIVTSENKSSFNLGTIETKSASVAPFTCKTSEAKKEEMPATKGGFSFGNVEPASLPSASVFVLGRTEEKQQEPVTSTSLVFGKKADNEEPKCQPVFSFGNSEQTKDENSSKSTFSFSMTKPSEKESEQPAKATFAFGAQTSTTADQGAAKPVFSFLNNSSSSSSTPATSAGGGIFGSSTSSSNPPVATFVFGQSSNPVSSSAFGNTAESSTSQSLLFSQDSKLATTSSTGTAVTPFVFGPGASSNNTTTSGFGFGATTTSSSAGSSFVFGTGPSAPSASPAFGANQTPTFGQSQGASQPNPPGFGSISSSTALFPTGSQPAPPTFGTVSSSSQPPVFGQQPSQSAFGSGTTPNSSSAFQFGSSTTNFNFTNNSPSGVFTFGANSSTPAASAQPSGSGGFPFNQSPAAFTVGSNGKNVFSSSGTSFSGRKIKTAVRRRK

SEQ ID NO: 148 - protein, 1382 aa, Homo sapiens
MPAYFQRPENALKRANEFLEVGKKQPALDVLYDVMKSKKHRTWQKIHEPIMLKYLELCVDLRKSHLAKEGLYQYKNICQQVNIKSLEDVVRAYLKMAEEKTEAAKEESQQMVLDIEDLDNIQTPESVLLSAVSGEDTQDRTDRLLLTPWVKFLWESYRQCLDLLRNNSRVERLYHDIAQQAFKFCLQYTRKAEFRKLCDNLRMHLSQIQRHHNQSTAINLNNPESQSMHLETRLVQLDSAISMELWQEAFKAVEDIHGLFSLSKKPPKPQLMANYYNKVSTVFWKSGNALFHASTLHRLYHLSREMRKNLTQDEMQRMSTRVLLATLSIPITPERTDIARLLDMDGIIVEKQRRLATLLGLQAPPTRIGLINDMVRFNVLQYVVPEVKDLYNWLEVEFNPLKLCERVTKVLNWVREQPEKEPELQQYVPQLQNNTILRLLQQVSQIYQSIEFSRLTSLVPFVDAFQLERAIVDAARHCDLQVRIDHTSRTLSFGSDLNYATREDAPIGPHLQSMPSEQIRNQLTAMSSVLAKALEVIKPAHILQEKEEQHQLAVTAYLKNSRKEHQRILARRQTIEERKERLESLNIQREKEELEQREAELQKVRKAEEERLRQEAKEREKERILQEHEQIKKKTVRERLEQIKKTELGAKAFKDIDIEDLEELDPDFIMAKQVEQLEKEKKELQERLKNQEKKIDYFERAKRLEEIPLIKSAYEEQRIKDMDLWEQQEEERITTMQLEREKALEHKNRMSRMLEDRDLFVMRLKAARQSVYEEKLKQFEERLAEERHNRLEERKRQRKEERRITYYREKEEEEQRRAEEQMLKEREERERAERAKREEELREYQERVKKLEEVERKKRQRELEIEERERRREEERRLGDSSLSRKDSRWGDRDSEGTWRKGPEADSEWRRGPPEKEWRRGEGRDEDRSHRRDEERPRRLGDDEDREPSLRPDDDRVPRRGMDDDRGPRRGPEEDRFSRRGADDDRPSWRNTDDDRPPRRIADEDRGNWRHADDDRPPRRGLDEDRGSWRTADEDRGPRRGMDDDRGPRRGGADDERSSWRNADDDRGPRRGLDDDRGPRRGMDDDRGPRRGMDDDRGPRRGMDDDRGPRRGLDDDRGPWRNADDDRIPRRGAEDDRGPWRNMDDDRLSRRADDDRFPRRGDDSRPGPWRPLVKPGGWREKEKAREESWGPPRESRPSEEREWDREKERDRDNQDREENDKDPERERDRERDVDREDRFRRPRDEGGWRRGPAEESSSWRDSSRRDDRDRDDRRRERDDRRDLRERRDLRDDRDRRGPPLRSEREEVSSWRRADDRKDDRVEERDPPRRVPPPALSRDRERDRDREREGEKEKASWRAEKDRESLRRTKNETDEDGWTTVRR

SEQ ID NO: 149 - protein, 657 aa, Homo sapiens
MSPTPPLFSLPEARTRFTKSTREALNNKNIKPLLSTFSQVPGSENEKKCTLDQAFRGILEEEIINHSSCENVLAIISLAIGGVTEGICTASTPFVLLGDVLDCLPLDQCDTIFTFVEKNVATWKSNTFYSAGKNYLLRMCNDLLRRLSKSQNTVFCGRIQLFLARLFPLSEKSGLNLQSQFNLENVTVFNTNEQESTLGQKHTEDREEGMDVEEGEMGDEEAPTTCSIPIDYNLYRKFWSLQDYFRNPVQCYEKISWKTFLKYSEEVLAVFKSYKLDDTQASRKKMEELKTGGEHVYFAKFLTSEKLMDLQLSDSNFRRHILLQYLILFQYLKGQVKFKSSNYVLTDEQSLWIEDTTKSVYQLLSENPPDGERFSKMVEHILNTEENWNSWKNEGCPSFVKERTSDTKPTRIIRKRTAPEDFLGKGPTKKILMGNEELTRLWNLCPDNMEACKSETREHMPTLEEFFEEAIEQADPENMVENEYKAVNNSNYGWRALRLLARRSPHFFQPTNQQFKSLPEYLENMVIKLAKELPPPSEEIKTGEDEDEEDNDALLKENESPDVRRDKPVTGEQIEVFANKLGEQWKILAPYLEMKDSEIRQIECDSEDMKMRAKQLLVAWQDQEGVHATPENLINALNKSGLSDLAESLTNDNETNS

SEQ ID NO: 150 - protein, 357 aa, Homo sapiens
MATPAVPVSAPPATPTPVPAAAPASVPAPTPAPAAAPVPAAAPASSSDPAAAAAATAAPGQTPASAQAPAQTPAPALPGPALPGPFPGGRVVRLHPVILASIVDSYERRNEGAARVIGTLLGTVDKHSVEVTNCFSVPHNESEDEVAVDMEFAKNMYELHKKVSPNELILGWYATGHDITEHSVLIHEYYSREAPNPIHLTVDTSLQNGRMSIKAYVSTLMGVPGRTMGVMFTPLTVKYAYYDTERIGVDLIMKTCFSPNRVIGLSSDLQQVGGASARIQDALSTVLQYAEDVLSGKVSADNTVGRFLMSLVNQVPKIVPDDFETMLNSNINDLLMVTYLANLTQSQIALNEKLVNL

SEQ ID NO: 151 - protein, 280 aa, Homo sapiens
MRRAELAGLKTMAWVPAESAVEELMPRLLPVEPCDLTEGFDPSVPPRTPQEYLRRVQIEAAQCPDVVVAQIDPKKLKRKQSVNISLSGCQPAPEGYSPTLQWQQQQVAQFSTVRQNVNKHRSHWKSQQLDSNVTMPKSEDEEGWKKFCLGEKLCADGAVGPATNESPGIDYVQIGFPPLLSIVSRMNQATVTSVLEYLSNWFGERDFTPELGRWLYALLACLEKPLLPEAHSLIRQLARRCSEVRLLVDSKDDERVPALNLLICLVSRYFDQRDLADEPS

SEQ ID NO: 152 - protein, 380 aa, Homo sapiens
MEEIYAKFVSQKISKTRWRPLPPGSLQTAETFATGSWDNEENYISLWSIGDFGNLDSDGGFEGDHQLLCDIRHHGDVMDLQFFDQERIVAASSTGCVTVFLHHPNNQTLSVNQQWTTAHYHTGPGSPSYSSAPCTGVVCNNPEIVTVGEDGRINLFRADHKEAVRTIDNADSSTLHAVTFLRTPEILTVNSIGQLKIWDFRQQGNEPSQILSLTGDRVPLHCVDRHPNQQHVVATGGQDGMLSIWDVRQGTMPVSLLKAHEAEMWEVHFHPSNPEHLFTCSEDGSLWHWDASTDVPEKSSLFHQGGRSSTFLSHSISNQANVHQSVISSWLSTDPAKDRIEITSLLPSRSLSVNTLDVLGPCLVCGTDAEAIYVTRHLFS

SEQ ID NO: 153 - protein, 204 aa, Homo sapiens
MEAAGSPAATETGKYIASTQRPDGTWRKQRRVKEGYVPQEEVPVYENKYVKFFKSKPELPPGLSPEATAPVTPSRPEGGEPGLSKTAKRNLKRKEKRRQQQEKGEAEALSRTLDKVSLEETAQLPSAPQGSRAAPTAASDQPDSAATTEKAKKIKNLKKKLRQVEELQQRIQAGEVSQPSKEQLEKLARRRALEEELEDLELGL

SEQ ID NO: 154 - protein, 1129 aa, Homo sapiens
MSVEAYGPSSQTLTFLDTEEAELLGADTQGSEFEFTDFTLPSQTQTPPGGPGGPGGGGAGGPGGAGAGAAAGQLDAQVGPEGILQNGAVDDSVAKTSQLLAELNFEEDEEDTYYTKDLPIHACSYCGIHDPACVVYCNTSKKWFCNGRGNTSGSHIVNHLVRAKCKEVTLHKDGPLGETVLECYNCGCRNVFLLGFIPAKADSVVVLLCRQPCASQSSLKDINWDSSQWQPLIQDRCFLSWLVKIPSEQEQLRARQITAQQINKLEELWKENPSATLEDLEKPGVDEEPQHVLLRYEDAYQYQNIFGPLVKLEADYDKKLKESQTQDNITVRWDLGLNKKRIAYFTLPKTDSGNEDLVIIWLRDMRLMQGDEICLRYKGDLAPLWKGIGHVIKVPDNYGDEIAIELRSSVGAPVEVTHNFQVDFVWKSTSFDRMQSALKTFAVDETSVSGYIYHKLLGHEVEDVIIKCQLPKRFTAQGLPDLNHSQVYAVKTVLQRPLSLIQGPPGTGKTVTSATIVYHLARQGNGPVLVCAPSNIAVDQLTEKIHQTGLKVVRLCAKSREAIDSPVSFLALHNQIRNMDSMPELQKLQQLKDETGELSSADEKRYRALKRTAERELLMNADVICCTCVGAGDPRLAKMQFRSILIDESTQATEPECMVPVVLGAKQLILVGDHCQLGPVVMCKKAAKAGLSQSLFERLVVLGIRPIRLQVQYRMHPALSAFPSNIFYEGSLQNGVTAADRVKKGFDFQWPQPDKPMFFYVTQGQEEIASSGTSYLNRTEAANVEKITTKLLKAGAKPDQIGIITPYEGQRSYLVQYMQFSGSLHTKLYQEVEIASVDAFQGREKDFIILSCVRANEHQGIGFLNDPRRLNVALTRARYGVIIVGNPKALSKQPLWNHLLNYYKEQKVLVEGPLNNLRESLMQFSKPRKLVNTINPGARFMTTAMYDAREAIIPGSVYDRSSQGRPSSMYFQTHDQIGMISAGPSHVAAMNIPIPFNLVMPPMPPPGYFGQANGPAAGRGTPKGKTGRGGRQKNRFGLPGPSQTNLPNSQASQDVASQPFSQGALTQGYISMSQPSQMSQPGLSQPELSQDSYLGDEFKSQIDVALSQDSTYQGERAYQHGGVTGLSQY

SEQ ID NO: 155 - protein, 1071 aa, Homo sapiens
MPAIMTMLADHAARQLLDFSQKLDINLLDNVVNCLYHGEGAQQRMAQEVLTHLKEHPDAWTRVDTILEFSQNMNTKYYGLQILENVIKTRWKILPRNQCEGIKKYVVGLIIKTSSDPTCVEKEKVYIGKLNMILVQILKQEWPKHWPTFISDIVGASRTSESLCQNNMVILKLLSEEVFDFSSGQITQVKSKHLKDSMCNEFSQIFQLCQFVMENSQNAPLVHATLETLLRFLNWIPLGYIFETKLISTLIYKFLNVPMFRNVSLKCLTEIAGVSVSQYEEQFVTLFTLTMMQLKQMLPLNTNIRLAYSNGKDDEQNFIQNLSLFLCTFLKEHDQLIEKRLNLRETLMEALHYMLLVSEVEETEIFKICLEYWNHLAAELYRESPFSTSASPLLSGSQHFDVPPRRQLYLPMLFKVRLLMVSRMAKPEEVLVVENDQGEVVREFMKDTDSINLYKNMRETLVYLTHLDYVDTERIMTEKLHNQVNGTEWSWKNLNTLCWAIGSISGAMHEEDEKRFLVTVIKDLLGLCEQKRGKDNKAIIASNIMYIVGQYPRFLRAHWKFLKTVVNKLFEFMHETHDGVQDMACDTFIKIAQKCRRHFVQVQVGEVMPFIDEILNNINTIICDLQPQQVHTFYEAVGYMIGAQTDQTVQEHLIEKYMLLPNQVWDSIIQQATKNVDILKDPETVKQLGSILKTNVRACKAVGHPFVIQLGRIYLDMLNVYKCLSENISAAIQANGEMVTKQPLIRSMRTVKRETLKLISGWVSRSNDPQMVAENFVPPLLDAVLIDYQRNVPAAREPEVLSTMAIIVNKLGGHITAEIPQIFDAVFECTLNMINKDFEEYPEHRTNFFLLLQAVNSHCFPAFLAIPPTQFKLVLDSIIWAFKHTMRNVADTGLQILFTLLQNVAQEEAAAQSFYQTYFCDILQHIFSVVTDTSHTAGLTMHASILAYMFNLVEEGKISTSLNPGNPVNNQIFLQEYVANLLKSAFPHLQDAQVKLFVTGLFSLNQDIPAFKEHLRDFLVQIKEFAGEDTSDLFLEEREIALRQADEEKHKRQMSVPGIFNPHEIPEEMCD

SEQ ID NO: 156 - protein, 636 aa, Homo sapiens
MNPSAPSYPMASLYVGDLHPDVTEAMLYEKFSPAGPILSIRVCRDMITRRSLGYAYVNFQQPADAERALDTMNFDVIKGKPVRIMWSQRDPSLRKSGVGNIFIKNLDKSIDNKALYDTFSAFGNILSCKVVCDENGSKGYGFVHFETQEAAERAIEKMNGMLLNDRKVFVGRFKSRKEREAELGARAKEFTNVYIKNFGEDMDDERLKDLFGKFGPALSVKVMTDESGKSKGFGFVSFERHEDAQKAVDEMNGKELNGKQIYVGRAQKKVERQTELKRKFEQMKQDRITRYQGVNLYVKNLDDGIDDERLRKEFSPFGTITSAKVMMEGGRSKGFGFVCFSSPEEATKAVTEMNGRIVATKPLYVALAQRKEERQAHLTNQYMQRMASVRAVPNPVINPYQPAPPSGYFMAAIPQTQNRAAYYPPSQIAQLRPSPRWTAQGARPHPFQNMPGAIRPAAPRPPFSTMRPASSQVPRVMSTQRVANTSTQTMGPRPAAAAAAATPAVRTVPQYKYAAGVRNPQQHLNAQPQVTMQQPAVHVQGQEPLTASMLASAPPQEQKQMLGERLFPLIQAMHPTLAGKITGMLLEIDNSELLHMLESPESLRSKVDEAVAVLQAHQAKEAAQKAVNSATGVPTV

SEQ ID NO: 157 - protein, 462 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEIVKEVSTYIKKIGYNPDTVAFVPISGWNGDNMLEPSANMPWFKGWKVTRKDGNASGTTLLEALDCILPPTRPTDKPLRLPLQDVYKIGGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGQISAGYAPVLDCHTAHIACKFAELKEKIDRRSGKKLEDGPKFLKSGDAAIVDMVPGKPMCVESFSDYPPLGRFAVRDMRQTVAVGVIKAVDKKAAGAGKVTKSAQKAQKAK

SEQ ID NO: 158 - protein, 131 aa, Homo sapiens
MQTPVNIPVPVLRLPRGPDGFSRGFAPDGRRAPLRPEVPEIQECPIAQESLESQEQRARAALRERYLRSLLAMVGHQVSFTLHEGVRVAAHFGATDLDVANFYVSQLQTPIGVQAEALLRCSDIISYTFKP

SEQ ID NO: 159 - protein, 434 aa, Homo sapiens
MLRCLYHWHRPVLNRRWSRLCLPKQYLFTMKLQSPEFQSLFTEGLKSLTELFVKENHELRIAGGAVRDLLNGVKPQDIDFATTATPTQMKEMFQSAGIRMINNRGEKHGTITARLHEENFEITTLRIDVTTDGRHAEVEFTTDWQKDAERRDLTINSMFLGFDGTLFDYFNGYEDLKNKKVRFVGHAKQRIQEDYLRILRYFRFYGRIVDKPGDHDPETLEAIAENAKGLAGISGERIWVELKKILVGNHVNHLIHLIYDLDVAPYIGLPANASLEEFDKVSKNVDGFSPKPVTLLASLFKVQDDVTKLDLRLKIAKEEKNLGLFIVKNRKDLIKATDSSDPLKPYQDFIIDSREPDATTRVCELLKYQGEHCLLKEMQQWSIPPFPVSGHDIRKVGISSGKEIGALLQQLREQWKKSGYQMEKDELLSYIKKT

SEQ ID NO: 160 - protein, 674 aa, Homo sapiens
MATAVSRPCAGRSRDILWRVLGWRIVASIVWSVLFLPICTTVFIIFSRIDLFHPIQWLSDSFSDLYSSYVIFYFLLLSVVIIIISIFNVEFYAVVPSIPCSRLALIGKIIHPQQLMHSFIHAAMGMVMAWCAAVITQGQYSFLVVPCTGTNSFGSPAAQTCLNEYHLFFLLTGAFMGYSYSLLYFVNNMNYLPFPIIQQYKFLRFRRSLLLLVKHSCVESLFLVRNFCILYYFLGYIPKAWISTAMNLHIDEQVHRPLDTVSGLLNLSLLYHVWLCGVFLLTTWYVSWILFKIYATEAHVFPVQPPFAEGSDECLPKVLNSNPPPIIKYLALQDLMLLSQYSPSRRQEVFSLSQPGGHPHNWTAISRECLNLLNGMTQKLILYQEAAATNGRVSSSYPVEPKKLNSPEETAFQTPKSSQMPRPSVPPLVKTSLFSSKLSTPDVVSPFGTPFGSSVMNRMAGIFDVNTCYGSPQSPQLIRRGPRLWTSASDQQMTEFSNPSPSTSISAEGKTMRQPSVIYSWIQNKREQIKNFLSKRVLIMYFFSKHPEASIQAVFSDAQMHIWALEGLSHLVAASFTEDRFGVVQTTLPAILNTLLTLQEAVDKYFKLPHASSKPPRISGSLVDTSYKTLRFAFRASLKTAIYRITTTFGEHLNAVQASAEHQKRLQQFLEFKE

SEQ ID NO: 161 - protein, 1156 aa, Homo sapiens
MFPAAPSPRTPGTGSRRGPLAGLGPGSTPRTASRKGLPLGSAVSSPVLFSPVGRRSSLSSRGTPTRMFPHHSITESVNYDVKTFGSSLPVKVMEALTLAEVDDQLTINIDEGGWACLVCKEKLIIWKIALSPITKLSVCKELQLPPSDFHWSADLVALSYSSPSGEAHSTQAVAVMVATREGSIRYWPSLAGEDTYTEAFVDSGGDKTYSFLTAVQGGSFILSSSGSQLIRLIPESSGKIHQHILPQGQGMLSGIGRKVSSLFGILSPSSDLTLSSVLWDRERSSFYSLTSSNISKWELDDSSEKHAYSWDINRALKENITDAIWGSESNYEAIKEGVNIRYLDLKQNCDGLVILAAAWHSADNPCLIYYSLITIEDNGCQMSDAVTVEVTQYNPPFQSEDLILCQLTVPNFSNQTAYLYNESAVYVCSTGTGKFSLPQEKIVFNAQGDSVLGAGACGGVPIIFSRNSGLVSITSRENVSILAEDLEGSLASSVAGPNSESMIFETTTKNETIAQEDKIKLLKAAFLQYCRKDLGHAQMVVDELFSSHSDLDSDSELDRAVTQISVDLMDDYPASDPRWAESVPEEAPGFSNTSLIILHQLEDKMKAHSFLMDFIHQVGLFGRLGSFPVRGTPMATRLLLCEHAEKLSAAIVLKNHHSRLSDLVNTAILIALNKREYEIPSNLTPADVFFREVSQVDTICECLLEHEEQVLRDAPMDSIEWAEVVINVNNILKDMLQAASHYRQNRNSLYRREESLEKEPEYVPWTATSGPGGIRTVIIRQHEIVLKVAYPQADSNLRNIVTEQLVALIDCFLDGYVSQLKSVDKSSNRERYDNLEMEYLQKRSDLLSPLLSLGQYLWAASLAEKYCDFDILVQMCEQTDNQSRLQRYMTQFADQNFSDFLFRWYLEKGKRGKLLSQPISQHGQLANFLQAHEHLSWLHEINSQELEKAHATLLGLANMETRYFAKKKTLLGLSKLAALASDFSEDMLQEKIEEMAEQERFLLHQETLPEQLLAEKQLNLSAMPVLTAPQLIGLYICEENRRANEYDFKKALDLLEYIDEEEDININDLKLEILCKALQRDNWSSSDGKDDPIEVSKDSIFVKILQKLLKDGIQLSEYLPEVKDLLQADQLGSLKSNPYFEFVLKANYEYYVQGQI

SEQ ID NO: 162 - protein, 1220 aa, Homo sapiens
MGKKQKNKSEDSTKDDIDLDALAAEIEGAGAAKEQEPQKSKGKKKKEKKKQDFDEDDILKELEELSLEAQGIKADRETVAVKPTENNEEEFTSKDKKKKGQKGKKQSFDDNDSEELEDKDSKSKKTAKPKVEMYSGSDDDDDFNKLPKKAKGKAQKSNKKWDGSEEDEDNSKKIKERSRINSSGESGDESDEFLQSRKGQKKNQKNKPGPNIESGNEDDDASFKIKTVAQKKAEKKERERKKRDEEKAKLRKLKEKEELETGKKDQSKQKESQRKFEEETVKSKVTVDTGVIPASEEKAETPTAAEDDNEGDKKKKDKKKKKGEKEEKEKEKKKGPSKATVKAMQEALAKLKEEEERQKREEEERIKRLEELEAKRKEEERLEQEKRERKKQKEKERKERLKKEGKLLTKSQREARARAEATLKLLQAQGVEVPSKDSLPKKRPIYEDKKRKKIPQQLESKEVSESMELCAAVEVMEQGVPEKEETPPPVEPEEEEDTEDAGLDDWEAMASDEETEKVEGNKVHIEVKENPEEEEEEEEEEEEDEESEEEEEEEGESEGSEGDEEDEKVSDEKDSGKTLDKKPSKEMSSDSEYDSDDDRTKEERAYDKAKRRIEKRRLEHSKNVNTEKLRAPIICVLGHVDTGKTKILDKLRHTHVQDGEAGGITQQIGATNVPLEAINEQTKMIKNFDRENVRIPGMLIIDTPGHESFSNLRNRGSSLCDIAILVVDIMHGLEPQTIESINLLKSKKCPFIVALNKIDRLYDWKKSPDSDVAATLKKQKKNTKDEFEERAKAIIVEFAQQGLNAALFYENKDPRTFVSLVPTSAHTGDGMGSLIYLLVELTQTMLSKRLAHCEELRAQVMEVKALPGMGTTIDVILINGRLKEGDTIIVPGVEGPIVTQIRGLLLPPPMKELRVKNQYEKHKEVEAAQGVKILGKDLEKTLAGLPLLVAYKEDEIPVLKDELIHELKQTLNAIKLEEKGVYVQASTLGSLEALLEFLKTSEVPYAGINIGPVHKKDVMKASVMLEHDPQYAVILAFDVRIERDAQEMADSLGVRIFSAEIIYHLFDAFTKYRQDYKKQKQEEFKHIAVFPCKIKILPQYIFNSRDPIVMGVTVEAGQVKQGTPMCVPSKNFVDIGIVTSIEINHKQVDVAKKGQEVCVKIEPIPGESPKMFGRHFEATDILVSKISRQSIDALKDWFRDEMQKSDWQLIVELKKVFEII

SEQ ID NO: 163 - protein, 1341 aa, Homo sapiens
MWRRKHPRTSGGTRGVLSGNRGVEYGSGRGHLGTFEGRWRKLPKMPEAVGTDPSTSRKMAELEEVTLDGKPLQALRVTDLKAALEQRGLAKSGQKSALVKRLKGALMLENLQKHSTPHAAFQPNSQIGEEMSQNSFIKQYLEKQQELLRQRLEREAREAAELEEASAESEDEMIHPEGVASLLPPDFQSSLERPELELSRHSPRKSSSISEEKGDSDDEKPRKGERRSSRVRQARAAKLSEGSQPAEEEEDQETPSRNLRVRADRNLKTEEEEEEEEEEEEDDEEEEGDDEGQKSREAPILKEFKEEGEEIPRVKPEEMMDERPKTRSQEQEVLERGGRFTRSQEEARKSHLARQQQEKEMKTTSPLEEEEREIKSSQGLKEKSKSPSPPRLTEDRKKASLVALPEQTASEEETPPPLLTKEASSPPPHPQLHSEEEIEPMEGPAPAVLIQLSPPNTDADTRELLVSQHTVQLVGGLSPLSSPSDTKAESPAEKVPEESVLPLVQKSTLADYSAQKDLEPESDRSAQPLPLKIEELALAKGITEECLKQPSLEQKEGRRASHTLLPSHRLKQSADSSSSRSSSSSSSSSRSRSRSPDSSGSRSHSPLRSKQRDVAQARTHANPRGRPKMGSRSTSESRSRSRSRSRSASSNSRKSLSPGVSRDSSTSYTETKDPSSGQEVATPPVPQLQVCEPKERTSTSSSSVQARRLSQPESAEKHVTQRLQPERGSPKKCEAEEAEPPAATQPQTSETQTSHLPESERIHHTVEEKEEVTMDTSENRPENDVPEPPMPIADQVSNDDRPEGSVEDEEKKESSLPKSFKRKISVVSATKGVPAGNSDTEGGQPGRKRRWGASTATTQKKPSISITTESLKSLIPDIKPLAGQEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 164 - protein, 257 aa, Homo sapiens
MADKMDMSLDDIIKLNRSQRGGRGGGRGRGRAGSQGGRGGGAQAAARVNRGGGPIRNRPAIARGAAGGGGRNRPAPYSRPKQLPDKWQHDLFDSGFGGGAGVETGGKLLVSNLDFGVSDADIQELFAEFGTLKKAAVHYDRSGRSLGTADVHFERKADALKAMKQYNGVPLDGRPMNIQLVTSQIDAQRRPAQSVNRGGMTRNRGAGGFGGGGGTRRGTRGGARGRGRGAGRNSKQQLSAEELDAQLDAYNARMDTS

SEQ ID NO: 165 - protein, 294 aa, Homo sapiens
MAMSSGGSGGGVPEQEDSVLFRRGTGQSDDSDIWDDTALIKAYDKAVASFKHALKNGDICETSGKPKTTPKRKPAKKNKSQKKNTAASLQQWKVGDKCSAIWSEDGCIYPATIASIDFKRETCVVVYTGYGNREEQNLSDLLSPICEVANNIEQNAQENENESQVSTDESENSRSPGNKSDNIKPKSAPWNSFLPPPPPMPGPRLGPGKPGLKFNGPPPPPPPPPPHLLSCWLPPFPSGPPIIPPPPPICPDSLDDADALGSMLISWYMSGYHTGYYMGFRQNQKEGRCSHSLN

SEQ ID NO: 166 - protein, 95 aa, Homo sapiens
MADEKPKEGVKTENNDHINLKVAGQDGSVVQFKIKRHTPLSKLMKAYCERQGLSMRQIRFRFDGQPINETDTPAQLEMEDEDTIDVFQQQTGGVY

SEQ ID NO: 167 - protein, 814 aa, Homo sapiens
MQDAENVAVPEAAEERAEPGQQQPAAEPPPAEGLLRPAGPGAPEAAGTEASSEEVGIAEAGPESEVRTEPAAEAEAASGPSESPSPPAAEELPGSHAEPPVPAQGEAPGEQARDERSDSRAQAVSEDAGGNEGRAAEAEPRALENGDADEPSFSDPEDFVDDVSEEELLGDVLKDRPQEADGIDSVIVVDNVPQVGPDRLEKLKNVIHKIFSKFGKITNDFYPEEDGKTKGYIFLEYASPAHAVDAVKNADGYKLDKQHTFRVNLFTDFDKYMTISDEWDIPEKQPFKDLGNLRYWLEEAECRDQYSVIFESGDRTSIFWNDVKDPVSIEERARWTETYVRWSPKGTYLATFHQRGIALWGGEKFKQIQRFSHQGVQLIDFSPCERYLVTFSPLMDTQDDPQAIIIWDILTGHKKRGFHCESSAHWPIFKWSHDGKFFARMTLDTLSIYETPSMGLLDKKSLKISGIKDFSWSPGGNIIAFWVPEDKDIPARVTLMQLPTRQEIRVRNLFNVVDCKLHWQKNGDYLCVKVDRTPKGTQGVVTNFEIFRMREKQVPVDVVEMKETIIAFAWEPNGSKFAVLHGEAPRISVSFYHVKNNGKIELIKMFDKQQANTIFWSPQGQFVVLAGLRSMNGALAFVDTSDCTVMNIAEHYMASDVEWDPTGRYVVTSVSWWSHKVDNAYWLWTFQGRLLQKNNKDRFCQLLWRPRPPTLLSQEQIKQIKKDLKKYSKIFEQKDRLSQSKASKELVERRRTMMEDFRKYRKMAQELYMEQKNERLELRGGVDTDELDSNVDDWEEETIEFFVTEEIIPLGNQE

SEQ ID NO: 168 - protein, 819 aa, Homo sapiens
MDTEGFGELLQQAEQLAAETEGISELPHVERNLQEIQQAGERLRSRTLTRTSQETADVKASVLLGSRGLDISHISQRLESLSAATTFEPLEPVKDTDIQGFLKNEKDNALLSAIEESRKRTFGMAEEYHRESMLVEWEQVKQRILHTLLASGEDALDFTQESEPSYISDVGPPGRSSLDNIEMAYARQIYIYNEKIVNGHLQPNLVDLCASVAELDDKSISDMWTMVKQMTDVLLTPATDALKNRSSVEVRMEFVRQALAYLEQSYKNYTLVTVFGNLHQAQLGGVPGTYQLVRSFLNIKLPAPLPGLQDGEVEGHPVWALIYYCMRCGDLLAASQVVNRAQHQLGEFKTWFQEYMNSKDRRLSPATENKLRLHYRRALRNNTDPYKRAVYCIIGRCDVTDNQSEVADKTEDYLWLKLNQVCFDDDGTSSPQDRLTLSQFQKQLLEDYGESHFTVNQQPFLYFQVLFLTAQFEAAVAFLFRMERLRCHAVHVALVLFELKLLLKSSGQSAQLLSHEPGDPPCLRRLNFVRLLMLYTRKFESTDPREALQYFYFLRDEKDSQGENMFLRCVSELVIESREFDMILGKLENDGSRKPGVIDKFTSDTKPIINKVASVAENKGLFEEAAKLYDLAKNADKVLELMNKLLSPVVPQISAPQSNKERLKNMALSIAERYRAQGISANKFVDSTFYLLLDLITFFDEYHSGHIDRAFDIIERLKLVPLNQESVEERVAAFRNFSDEIRHNLSEVLLATMNILFTQFKRLKGTSPSSSSRPQRVIEDRDSQLRSQARTLITFAGMIPYRTSGDTNARLVQMEVLMN

SEQ ID NO: 169 - protein, 163 aa, Homo sapiens
MEHYRKAGSVELPAPSPMPQLPPDTLEMRVRDGSKIRNLLGLALGRLEGGSARHVVFSGSGRAAGKAVSCAEIVKRRVPGLHQLTKLRFLQTEDSWVPASPDTGLDPLTVRRHVPAVWVLLSRDPLDPNECGYQPPGAPPGLGSMPSSSCGPRSRRRARDTRS

SEQ ID NO: 170 - protein, 622 aa, Homo sapiens
MSEREERRFVEIPRESVRLMAESTGLELSDEVAALLAEDVCYRLREATQNSSQFMKHTKRRKLTVEDFNRALRWSSVEAVCGYGSQEALPMRPAREGELYFPEDREVNLVELALATNIPKGCAETAVRVHVSYLDGKGNLAPQGSVPSAVSSLTDDLLKYYHQVTRAVLGDDPQLMKVALQDLQTNSKIGALLPYFVYVVSGVKSVSHDLEQLHRLLQVARSLFRNPHLCLGPYVRCLVGSVLYCVLEPLAASINPLNDHWTLRDGAALLLSHIFWTHGDLVSGLYQHILLSLQKILADPVRPLCCHYGAVVGLHALGWKAVERVLYPHLSTYWTNLQAVLDDYSVSNAQVKADGHKVYGAILVAVERLLKMKAQAAEPNRGGPGGRGCRRLDDLPWDSLLFQESSSGGGAEPSFGSGLPLPPGGAGPEDPSLSVTLADIYRELYAFFGDSLATRFGTGQPAPTAPRPPGDKKEPAAAPDSVRKMPQLTASAIVSPHGDESPRGSGGGGPASASGPAASESRPLPRVHRARGAPRQQGPGTGTRDVFQKSRFAPRGAPHFRFIIAGRQAGRRCRGRLFQTAFPAPYGPSPASRYVQKLPMIGRTSRPARRWALSDYSLYLPL

SEQ ID NO: 171 - protein, 323 aa, Homo sapiens
MYHNSSQKRHWTFSSEEQLARLRADANRKFRCKAVANGKVLPNDPVFLEPHEEMTLCKYYEKRLLEFCSVFKPAMPRSVVGTACMYFKRFYLNNSVMEYHPRIIMLTCAFLACKVDEFNVSSPQFVGNLRESPLGQEKALEQILEYELLLIQQLNFHLIVHNPYRPFEGFLIDLKTRYPILENPEILRKTADDFLNRIALTDAYLLYTPSQIALTAILSSASRAGITMESYLSESLMLKENRTCLSQLLDIMKSMRNLVKKYEPPRSEEVAVLKQKLERCHSAELALNVITKKRKGYEDDDYVSKKSKHEEEEWTDDDLVESL

SEQ ID NO: 172 - protein, 308 aa, Homo sapiens
MVSDEDELNLLVIVVDANPIWWGKQALKESQFTLSKCIDAVMVLGNSHLFMNRSNKLAVIASHIQESRFLYPGKNGRLGDFFGDPGNPPEFNPSGSKDGKYELLTSANEVIVEEIKDLMTKSDIKGQHTETLLAGSLAKALCYIHRMNKEVKDNQEMKSRILVIKAAEDSALQYMNFMNVIFAAQKQNILIDACVLDSDSGLLQQACDITGGLYLKVPQMPSLLQYLLWVFLPDQDQRSQLILPPPVHVDYRAACFCHRNLIEIGYVCSVCLSIFCNFSPICTTCETAFKISLPPVLKAKKKKLKVSA

SEQ ID NO: 173 - protein, 316 aa, Homo sapiens
MASTSRLDALPRVTCPNHPDAILVEDYRAGDMICPECGLVVGDRVIDVGSEWRTFSNDKATKDPSRVGDSQNPLLSDGDLSTMIGKGTGAASFDEFGNSKYQNRRTMSSSDRAMMNAFKEITTMADRINLPRNIVDRTNNLFKQVYEQKSLKGRANDAIASACLYIACRQEGVPRTFKEICAVSRISKKEIGRCFKLILKALETSVDLITTGDFMSRFCSNLCLPKQVQMAATHIARKAVELDLVPGRSPISVAAAAIYMASQASAEKRTQKEIGDIAGVADVTIRQSYRLIYPRAPDLFPTDFKFDTPVDKLPQL

SEQ ID NO: 174 - protein, 249 aa, Homo sapiens
MAERGELDLTGAKQNTGVWLVKVPKYLSQQWAKASGRGEVGKLRIAKTQGRTEVSFTLNEDLANIHDIGGKPASVSAPREHPFVLQSVGGQTLTVFTESSSDKLSLEGIVVQRAECRPAASENYMRLKRLQIEESSKPVRLSQQLDKVVTTNYKPVANHQYNIEYERKKKEDGKRARADKQHVLDMLFSAFEKHQYYNLKDLVDITKQPVVYLKEILKEIGVQNVKGIHKNTWELKPEYRHYQGEEKSD

SEQ ID NO: 175 - protein, 929 aa, Homo sapiens
MCESYSRSLLRVSVAQICQALGWDSVQLSACHLLTDVLQRYLQQLGRGCHRYSELYGRTDPILDDVGEAFQLMGVSLHELEDYIHNIEPVTFPHQIPSFPVSKNNVLQFPQPGSKDAEERKEYIPDYLPPIVSSQEEEEEEQVPTDGGTSAEAMQVPLEEDDELEEEEIINDENFLGKRPLDSPEAEELPAMKRPRLLSTKGDTLDVVLLEAREPLSSINTQKIPPMLSPVHVQDSTDLAPPSPEPPMLAPVAKSQMPTAKPLETKSFTPKTKTKTSSPGQKTKSPKTAQSPAMVGSPIRSPKTVSKEKKSPGRSKSPKSPKSPKVTTHIPQTPVRPETPNRTPSATLSEKISKETIQVKQIQTPPDAGKLNSENQPKKAVVADKTIEASIDAVIARACAEREPDPFEFSSGSESEGDIFTSPKRISGPECTTPKASTSANNFTKSGSTPLPLSGGTSSSDNSWTMDASIDEVVRKAKLGTPSNMPPNFPYISSPSVSPPTPEPLHKVYEEKTKLPSSVEVKKKLKKELKTKMKKKEKQRDREREKDKNKDKSKEKDKVKEKEKDKETGRETKYPWKEFLKEEEADPYKFKIKEFEDVDPKVKLKDGLVRKEKEKHKDKKKDREKGKKDKDKREKEKVKDKGREDKMKAPAPPLVLPPKELALPLFSPATASRVPAMLPSLLPVLPEKLFEEKEKVKEKEKKKDKKEKKKKKEKEKEKKEKEREKEKREREKREKEKEKHKHEKIKVEPVALAPSPVIPRLTLRVGAGQDKIVISKVVPAPEAKPAPSQNRPKTPPPAPAPAPGPMLVSPAPVPLPLLAQAAAGPALLPSPGPAASGASAKAPVRSVVTETVSTYVIRDEWGNQIWICPGCNKPDDGSPMIGCDDCDDWYHWPCVGIMTAPPEEMQWFCPKCANKKKDKKHKKRKHRAH

SEQ ID NO: 176 - protein, 1199 aa, Homo sapiens
MPLTGVEPARMNRKKGDKGFESPRPYKLTHQVVCINNINFQRKSVVGFVELTIFPTVANLNRIKLNSKQCRIYRVRINDLEAAFIYNDPTLEVCHSESKQRNLNYFSNAYAAAVSAVDPDAGNGELCIKVPSELWKHVDELKVLKIHINFSLDQPKGGLHFVVPSVEGSMAERGAHVFSCGYQNSTRFWFPCVDSYSELCTWKLEFTVDAAMVAVSNGDLVETVYTHDMRKKTFHYMLTIPTAASNISLAIGPFEILVDPYMHEVTHFCLPQLLPLLKHTTSYLHEVFEFYEEILTCRYPYSCFKTVFIDEAYVEVAAYASMSIFSTNLLHSAMIIDETPLTRRCLAQSLAQQFFGCFISRMSWSDEWVLKGISGYIYGLWMKKTFGVNEYRHWIKEELDKIVAYELKTGGVLLHPIFGGGKEKDNPASHLHFSIKHPHTLSWEYYSMFQCKAHLVMRLIENRISMEFMLQVFNKLLSLASTASSQKFQSHMWSQMLVSTSGFLKSISNVSGKDIQPLIKQWVDQSGVVKFYGSFAFNRKRNVLELEIKQDYTSPGTQKYVGPLKVTVQELDGSFNHTLQIEENSLKHDIPCHSKSRRNKKKKIPLMNGEEVDMDLSAMDADSPLLWIRIDPDMSVLRKVEFEQADFMWQYQLRYERDVVAQQESILALEKFPTPASRLALTDILEQEQCFYRVRMSACFCLAKIANSMVSTWTGPPAMKSLFTRMFCCKSCPNIVKTNNFMSFQSYFLQKTMPVAMALLRDVHNLCPKEVLTFILDLIKYNDNRKNKFSDNYYRAEMIDALANSVTPAVSVNNEVRTLDNLNPDVRLILEEITRFLNMEKLLPSYRHTITVSCLRAIRVLQKNGHVPSDPALFKSYAEYGHFVDIRIAALEAVVDYTKVDRSYEELQWLLNMIQNDPVPYVRHKILNMLTKNPPFTKNMESPLCNEALVDQLWKLMNSGTSHDWRLRCGAVDLYFTLFGLSRPSCLPLPELGLVLNLKEKKAVLNPTIIPESVAGNQEAANNPSSHPQLVGFQNPFSSSQDEEEIDMDTVHDSQAFISHHLNMLERPSTPGLSKYRPASSRSALIPQHSAGCDSTPTTKPQWSLELARKGTGKEQAPLEMSMHPAASAPLSVFTKESTASKHSDHHHHHHHEHKKKKKKHKHKHKHKHKHDSKEKDKEPFTFSSPASGRSIRSPSLSD

SEQ ID NO: 177 - protein, 1872 aa, Homo sapiens
MGPGCDLLLRTAATITAAAIMSDTDSDEDSAGGGPFSLAGFLFGNINGAGQLEGESVLDDECKKHLAGLGALGLGSLITELTANEELTGTDGALVNDEGWVRSTEDAVDYSDINEVAEDESRRYQQTMGSLQPLCHSDYDEDDYDADCEDIDCKLMPPPPPPPGPMKKDKDQDSITGEKVDFSSSSDSESEMGPQEATQAESEDGKLTLPLAGIMQHDATKLLPSVTELFPEFRPGKVLRFLRLFGPGKNVPSVWRSARRKRKKKHRELIQEEQIQEVECSVESEVSQKSLWNYDYAPPPPPEQCLSDDEITMMAPVESKFSQSTGDIDKVTDTKPRVAEWRYGPARLWYDMLGVPEDGSGFDYGFKLRKTEHEPVIKSRMIEEFRKLEENNGTDLLADENFLMVTQLHWEDDIIWDGEDVKHKGTKPQRASLAGWLPSSMTRNAMAYNVQQGFAATLDDDKPWYSIFPIDNEDLVYGRWEDNIIWDAQAMPRLLEPPVLTLDPNDENLILEIPDEKEEATSNSPSKESKKESSLKKSRILLGKTGVIKEEPQQNMSQPEVKDPWNLSNDEYYYPKQQGLRGTFGGNIIQHSIPAVELRQPFFPTHMGPIKLRQFHRPPLKKYSFGALSQPGPHSVQPLLKHIKKKAKMREQERQASGGGEMFFMRTPQDLTGKDGDLILAEYSEENGPLMMQVGMATKIKNYYKRKPGKDPGAPDCKYGETVYCHTSPFLGSLHPGQLLQAFENNLFRAPIYLHKMPETDFLIIRTRQGYYIRELVDIFVVGQQCPLFEVPGPNSKRANTHIRDFLQVFIYRLFWKSKDRPRRIRMEDIKKAFPSHSESSIRKRLKLCADFKRTGMDSNWWVLKSDFRLPTEEEIRAMVSPEQCCAYYSMIAAEQRLKDAGYGEKSFFAPEEENEEDFQMKIDDEVRTAPWNTTRAFIAAMKGKCLLEVTGVADPTGCGEGFSYVKIPNKPTQQKDDKEPQPVKKTVTGTDADLRRLSLKNAKQLLRKFGVPEEEIKKLSRWEVIDVVRTMSTEQARSGEGPMSKFARGSRFSVAEHQERYKEECQRIFDLQNKVLSSTEVLSTDTDSSSAEDSDFEEMGKNIENMLQNKKTSSQLSREREEQERKELQRMLLAAGSAASGNNHRDDDTASVTSLNSSATGRCLKIYRTFRDEEGKEYVRCETVRKPAVIDAYVRIRTTKDEEFIRKFALFDEQHREEMRKERRRIQEQLRRLKRNQEKEKLKGPPEKKPKKMKERPDLKLKCGACGAIGHMRTNKFCPLYYQTNAPPSNPVAMTEEQEEELEKTVIHNDNEELIKVEGTKIVLGKQLIESADEVRRKSLVLKFPKQQLPPKKKRRVGTTVHCDYLNRPHKSIHRRRTDPMVTLSSILESIINDMRDLPNTYPFHTPVNAKVVKDYYKIITRPMDLQTLRENVRKRLYPSREEFREHLELIVKNSATYNGPKHSLTQISQSMLDLCDEKLKEKEDKLARLEKAINPLLDDDDQVAFSFILDNIVTQKMMAVPDSWPFHHPVNKKFVPDYYKVIVNPMDLETIRKNISKHKYQSRESFLDDVNLILANSVKYNGPESQYTKTAQEIVNVCYQTLTEYDEHLTQLEKDICTAKEAALEEAELESLDPMTPGPYTPQPPDLYDTNTSLSMSRDASVFQDESNMSVLDIPSATPEKQVTQEGEDGDGDLADEEEGTVQQPQASVLYEDLLMSEGEDDEEDAGSDEEGDNPFSAIQLSESGSDSDVGSGGIRPKQPRMLQENTRMDMENEESMMSYEGDGGEASHGLEDSNISYGSYEEPDPKSNTQDTSFSSIGGYEVSEEEEDEEEEEQRSGPSVLSQVHLSEDEEDSEDFHSIAGDSDLDSDE

SEQ ID NO: 178 - protein, 349 aa, Homo sapiens
MSKSKDDAPHELESQFILRLPPEYASTVRRAVQSGHVNLKDRLTIELHPDGRHGIVRVDRVPLASKLVDLPCVMESLKTIDKKTFYKTADICQMLVSTVDGDLYPPVEEPVASTDPKASKKKDKDKEKKFIWNHGITLPLKNVRKRRFRKTAKKKYIESPDVEKEVKRLLSTDAEAVSTRWEIIAEDETKEAENQGLDISSPGMSGHRQGHDSLEHDELREIFNDLSSSSEDEDETQHQDEEDINIIDTEEDLERQLQDKLNESDEQHQENEGTNQLVMGIQKQIDNMKGKLQETQDRAKRQEDLIMKVENLALKNRFQAVLDELKQKEDREKEQLSSLQEELESLLEK

SEQ ID NO: 179 - protein, 218 aa, Homo sapiens
MSCSGSGADPEAAPASAASAPGPAPPVSAPAALPSSTAAENKASPAGTAGGPGAGAAAGGTGPLAARAGEPAERRGAAPVSAGGAAPPEGAISNGVYVLPSAANGDVKPVVSSTPLVDFLMQLEDYTPTIPDAVTGYYLNRAGFEASDPRIIRLISLAAQKFISDIANDALQHCKMKGTASGSSRSKSKDRKYTLTMEDLTPALSEYGINVKKPHYFT

SEQ ID NO: 180 - protein, 211 aa, Homo sapiens
MDDAHESPSDKGGETGESDETAAVPGDPGATDTDGIPEETDGDADVDLKEAAAEEGELESQDVSDLTTVEREDSSLLNPAAKKLKIDTKEKKEKKQKVDEDEIQKMQILVSSFSEEQLNRYEMYRRSAFPKAAIKRLIQSITGTSVSQNVVIAMSGISKVFVGEVVEEALDVCEKWGEMPPLQPKHMREAVRRLKSKGQIPNSKHKKIIFF

SEQ ID NO: 181 - protein, 124 aa, Homo sapiens
MADEEEDPTFEEENEEIGGGAEGGQGKRKRLFSKELRCMMYGFGDDQNPYTESVDILEDLVIEFITEMTHKAMSIGRQGRVQVEDIVFLIRKDPRKFARVKDLLTMNEELKRARKAFDEANYGS

SEQ ID NO: 182 - protein, 782 aa, Homo sapiens
MGKRDRADRDKKKSRKRHYEDEEDDEEDAPGNDPQEAVPSAAGKQVDESGTKVDEYGAKDYRLQMPLKDDHTSRPLWVAPDGHIFLEAFSPVYKYAQDFLVAIAEPVCRPTHVHEYKLTAYSLYAAVSVGLQTSDITEYLRKLSKTGVPDGIMQFIKLCTVSYGKVKLVLKHNRYFVESCHPDVIQHLLQDPVIRECRLRNSEGEATELITETFTSKSAISKTAESSGGPSTSRVTDPQGKSDIPMDLFDFYEQMDKDEEEEEETQTVSFEVKQEMIEELQKRCIHLEYPLLAEYDFRNDSVNPDINIDLKPTAVLRPYQEKSLRKMFGNGRARSGVIVLPCGAGKSLVGVTAACTVRKRCLVLGNSAVSVEQWKAQFKMWSTIDDSQICRFTSDAKDKPIGCSVAISTYSMLGHTTKRSWEAERVMEWLKTQEWGLMILDEVHTIPAKMFRRVLTIVQAHCKLGLTATLVREDDKIVDLNFLIGPKLYEANWMELQNNGYIAKVQCAEVWCPMSPEFYREYVAIKTKKRILLYTMNPNKFRACQFLIKFHERRNDKIIVFADNVFALKEYAIRLNKPYIYGPTSQGERMQILQNFKHNPKINTIFISKVGDTSFDLPEANVLIQISSHGGSRRQEAQRLGRVLRAKKGMVAEEYNAFFYSLVSQDTQEMAYSTKRQRFLVDQGYSFKVITKLAGMEEEDLAFSTKEEQQQLLQKVLAATDLDAEEEVVAGEFGSRSSQASRRFGTMSSMSGADDTVYMEYHSSRSKAPSKHVHPLFKRFRK

SEQ ID NO: 183 - protein, 339 aa, Homo sapiens
MDQNNSLPPYAQGLASPQGAMTPGIPIFSPMMPYGTGLTPQPIQNTNSLSILEEQQRQQQQQQQQQQQQQQQQQQQQQQQQQQQQQQQQQQQQQQAVAAAAVQQSTSQQATQGTSGQAPQLFHSQTLTTAPLPGTTPLYPSPMTPMTPITPATPASESSGIVPQLQNIVSTVNLGCKLDLKTIALRARNAEYNPKRFAAVIMRIREPRTTALIFSSGKMVCTGAKSEEQSRLAARKYARVVQKLGFPAKFLDFKIQNMVGSCDVKFPIRLEGLVLTHQQFSSYEPELFPGLIYRMIKPRIVLLIFVSGKVVLTGAKVRAEIYEAFENIYPILKGFRKTT

SEQ ID NO: 184 - protein, 593 aa, Homo sapiens
MLRTSVLRLLGRTGASRLSLLEDFGPRYYSSGSLSAGDDACDVRAYFTTPIFYVNAAPHIGHLYSALLADALCRHRRLRGPSTAATRFSTGTDEHGLKIQQAAATAGLAPTELCDRVSEQFQQLFQEAGISCTDFIRTTEARHRVAVQHFWGVLKSRGLLYKGVYEGWYCASDECFLPEAKVTQQPGPSGDSFPVSLESGHPVSWTKEENYIFRLSQFRKPLQRWLRGNPQAITPEPFHHVVLQWLDEELPDLSVSRRSSHLHWGIPVPGDDSQTIYVWLDALVNYLTVIGYPNAEFKSWWPATSHIIGKDILKFHAIYWPAFLLGAGMSPPQRICVHSHWTVCGQKMSKSLGNVVDPRTCLNRYTVDGFRYFLLRQGVPNWDCDYYDEKVVKLLNSELADALGGLLNRCTAKRINPSETYPAFCTTCFPSEPGLVGPSVRAQAEDYALVSAVATLPKQVADHYDNFRIYKALEAVSSCVRQTNGFVQRHAPWKLNWESPVDAPWLGTVLHVALECLRVFGTLLQPVTPSLADKLLSRLGVSASERSLGELYFLPRFYGHPCPFEGRRLGPETGLLFPRLDQSRTWLVKAHRT

SEQ ID NO: 185 - protein, 660 aa, Homo sapiens
MDVLVSECSARLLQQEEEIKSLTAEIDRLKNCGCLGASPNLEQLQEENLKLKYRLNILRKSLQAERNKPTKNMINIISRLQEVFGHAIKAAYPDLENPPLLVTPSQQAKFGDYQCNSAMGISQMLKTKEQKVNPREIAENITKHLPDNECIEKVEIAGPGFINVHLRKDFVSEQLTSLLVNGVQLPALGENKKVIVDFSSPNIAKEMHVGHLRSTIIGESISRLFEFAGYDVLRLNHVGDWGTQFGMLIAHLQDKFPDYLTVSPPIGDLQVFYKESKKRFDTEEEFKKRAYQCVVLLQGKNPDITKAWKLICDVSRQELNKIYDALDVSLIERGESFYQDRMNDIVKEFEDRGFVQVDDGRKIVFVPGCSIPLTIVKSDGGYTYDTSDLAAIKQRLFEEKADMIIYVVDNGQSVHFQTIFAAAQMIGWYDPKVTRVFHAGFGVVLGEDKKKFKTRSGETVRLMDLLGEGLKRSMDKLKEKERDKVLTAEELNAAQTSVAYGCIKYADLSHNRLNDYIFSFDKMLDDRGNTAAYLLYAFTRIRSIARLANIDEEMLQKAARETKILLDHEKEWKLGRCILRFPEILQKILDDLFLHTLCDYIYELATAFTEFYDSCYCVEKDRQTGKILKVNMWRMLLCEAVAAVMAKGFDILGIKPVQRM

SEQ ID NO: 186 - protein, 136 aa, Homo sapiens
MWSRLVWLGLRAPLGGRQGFTSKADPQGSGRITAAVIEHLERLALVDFGSREAVARLEKAIAFADRLRAVDTDGVEPMESVLEDRCLYLRSDNVVEGNCADELLQNSHRVVEEYFVAPPGNISLPKLDEQEPFPHS

SEQ ID NO: 187 - protein, 528 aa, Homo sapiens
MLGRSLREVSAALKQGQITPTELCQKCLSLIKKTKFLNAYITVSEEVALKQAEESEKRYKNGQSLGDLDGIPIAVKDNFSTSGIETTCASNMLKGYIPPYNATVVQKLLDQGALLMGKTNLDEFAMGSGSTDGVFGPVKNPWSYSKQYREKRKQNPHSENEDSDWLITGGSSGGSAAAVSAFTCYAALGSDTGGSTRNPAAHCGLVGFKPSYGLVSRHGLIPLVNSMDVPGILTRCVDDAAIVLGALAGPDPRDSTTVHEPINKPFMLPSLADVSKLCIGIPKEYLVPELSSEVQSLWSKAADLFESEGAKVIEVSLPHTSYSIVCYHVLCTSEVASNMARFDGLQYGHRCDIDVSTEAMYAATRREGFNDVVRGRILSGNFFLLKENYENYFVKAQKVRRLIANDFVNAFNSGVDVLLTPTTLSEAVPYLEFIKEDNRTRSAQDDIFTQAVNMAGLPAVSIPVALSNQGLPIGLQFIGRAFCDQQLLTVAKWFEKQVQFPVIQLQELMDDCSAVLENEKLASVSLKQ

SEQ ID NO: 188 - protein, 108 aa, Homo sapiens
MLLFCPGCGNGLIVEEGQRCHRFSCNTCPYVHNITRKVTNRKYPKLKEVDDVLGGAAAWENVDSTAESCPKCEHPRAYFMQLQTRSADEPMTTFYKCCNAQCGHRWRD

SEQ ID NO: 189 - protein, 126 aa, Homo sapiens
MSVMDLANTCSSFQSDLDFCSDCGSVLPLPGAQDTVTCIRCGFNINVRDFEGKVVKTSVVFHQLGTAMPMSVEEGPECQGPVVDRRCPRCGHEGMAYHTRQMRSADEGQTVFYTCTNCKFQEKEDS

SEQ ID NO: 190 - protein, 783 aa, Homo sapiens
MAACRYCCSCLRLRPLSDGPFLLPRRDRALTQLQVRALWSSAGSRAVAVDLGNRKLEISSGKLARFADGSAVVQSGDTAVMVTAVSKTKPSPSQFMPLVVDYRQKAAAAGRIPTNYLRREIGTSDKEILTSRIIDRSIRPLFPAGYFYDTQVLCNLLAVDGVNEPDVLAINGASVALSLSDIPWNGPVGAVRIGIIDGEYVVNPTRKEMSSSTLNLVVAGAPKSQIVMLEASAENILQQDFCHAIKVGVKYTQQIIQGIQQLVKETGVTKRTPQKLFTPSPEIVKYTHKLAMERLYAVFTDYEHDKVSRDEAVNKIRLDTEEQLKEKFPEADPYEIIESFNVVAKEVFRSIVLNEYKRCDGRDLTSLRNVSCEVDMFKTLHGSALFQRGQTQVLCTVTFDSLESGIKSDQVITAINGIKDKNFMLHYEFPPYATNEIGKVTGLNRRELGHGALAEKALYPVIPRDFPFTIRVTSEVLESNGSSSMASACGGSLALMDSGVPISSAVAGVAIGLVTKTDPEKGEIEDYRLLTDILGIEDYNGDMDFKIAGTNKGITALQADIKLPGIPIKIVMEAIQQASVAKKEILQIMNKTISKPRASRKENGPVVETVQVPLSKRAKFVGPGGYNLKKLQAETGVTISQVDEETFSVFAPTPSAMHEARDFITEICKDDQEQQLEFGAVYTATITEIRDTGVMVKLYPNMTAVLLHNTQLDQRKIKHPTALGLEVGQEIQVKYFGRDPADGRMRLSRKVLQSPATTVVRTLNDRSSIVMGEPISQSSSNSQ

SEQ ID NO: 191 - protein, 1135 aa, Homo sapiens
MDPGSRWRNLPSGPSLKHLTDPSYGIPREQQKAALQELTRAHVESFNYAVHEGLGLAVQAIPPFEFAFKDERISFTILDAVISPPTVPKGTICKEANVYPAECRGRRSTYRGKLTADINWAVNGISKGIIKQFLGYVPIMVKSKLCNLRNLPPQALIEHHEEAEEMGGYFIINGIEKVIRMLIMPRRNFPIAMIRPKWKTRGPGYTQYGVSMHCVREEHSAVNMNLHYLENGTVMLNFIYRKELFFLPLGFALKALVSFSDYQIFQELIKGKEDDSFLRNSVSQMLRIVMEEGCSTQKQVLNYLGECFRVKLNVPDWYPNEQAAEFLFNQCICIHLKSNTEKFYMLCLMTRKLFALAKGECMEDNPDSLVNQEVLTPGQLFLMFLKEKLEGWLVSIKIAFDKKAQKTSVSMNTDNLMRIFTMGIDLTKPFEYLFATGNLRSKTGLGLLQDSGLCVVADKLNFIRYLSHFRCVHRGADFAKMRTTTVRRLLPESWGFLCPVHTPDGEPCGLMNHLTAVCEVVTQFVYTASIPALLCNLGVTPIDGAPHRSYSECYPVLLDGVMVGWVDKDLAPGIADSLRHFKVLREKRIPPWMEVVLIPMTGKPSLYPGLFLFTTPCRLVRPVQNLALGKEELIGTMEQIFMNVAIFEDEVFAGVTTHQELFPHSLLSVIANFIPFSDHNQSPRNMYQCQMGKQTMGFPLLTYQDRSDNKLYRLQTPQSPLVRPSMYDYYDMDNYPIGTNAIVAVISYTGYDMEDAMIVNKASWERGFAHGSVYKSEFIDLSEKIKQGDSSLVFGIKPGDPRVLQKLDDDGLPFIGAKLQYGDPYYSYLNLNTGESFVMYYKSKENCVVDNIKVCSNDTGSGKFKCVCITMRVPRNPTIGDKFASRHGQKGILSRLWPAEDMPFTESGMVPDILFNPHGFPSRMTIGMLIESMAGKSAALHGLCHDATPFIFSEENSALEYFGEMLKAAGYNFYGTERLYSGISGLELEADIFIGVVYYQRLRHMVSDKFQVRTTGARDRVTNQPIGGRNVQGGIRFGEMERDALLAHGTSFLLHDRLFNCSDRSVAHVCVKCGSLLSPLLEKPPPSWSAMRNRKYNCTLCSRSDTIDTVSVPYVFRYFVAELAAMNIKVKLDVV

SEQ ID NO: 192 - protein, 169 aa, Homo sapiens
MICLVLTIFANLFPAACTGAHERTFLAVKPDGVQRRLVGEIVRRFERKGFKLVALKLVQASEELLREHYAELRERPFYGRLVKYMASGPVVAMVWQGLDVVRTSRALIGATNPADAPPGTIRGDFCIEVGKNLIHGSDSVESARREIALWFRADELLCWEDSAGHWLYE

SEQ ID NO: 193 - protein, 1107 aa, Homo sapiens
MDGKRRPGPGPGVPPKRARGGLWDDDDAPRPSQFEEDLALMEEMEAEHRLQEQEEEELQSVLEGVADGQVPPSAIDPRWLRPTPPALDPQTEPLIFQQLEIDHYVGPAQPVPGGPPPSRGSVPVLRAFGVTDEGFSVCCHIHGFAPYFYTPAPPGFGPEHMGDLQRELNLAISRDSRGGRELTGPAVLAVELCSRESMFGYHGHGPSPFLRITVALPRLVAPARRLLEQGIRVAGLGTPSFAPYEANVDFEIRFMVDTDIVGCNWLELPAGKYALRLKEKATQCQLEADVLWSDVVSHPPEGPWQRIAPLRVLSFDIECAGRKGIFPEPERDPVIQICSLGLRWGEPEPFLRLALTLRPCAPILGAKVQSYEKEEDLLQAWSTFIRIMDPDVITGYNIQNFDLPYLISRAQTLKVQTFPFLGRVAGLCSNIRDSSFQSKQTGRRDTKVVSMVGRVQMDMLQVLLREYKLRSYTLNAVSFHFLGEQKEDVQHSIITDLQNGNDQTRRRLAVYCLKDAYLPLRLLERLMVLVNAVEMARVTGVPLSYLLSRGQQVKVVSQLLRQAMHEGLLMPVVKSEGGEDYTGATVIEPLKGYYDVPIATLDFSSLYPSIMMAHNLCYTTLLRPGTAQKLGLTEDQFIRTPTGDEFVKTSVRKGLLPQILENLLSARKRAKAELAKETDPLRRQVLDGRQLALKVSANSVYGFTGAQVGKLPCLEISQSVTGFGRQMIEKTKQLVESKYTVENGYSTSAKVVYGDTDSVMCRFGVSSVAEAMALGREAADWVSGHFPSPIRLEFEKVYFPYLLISKKRYAGLLFSSRPDAHDRMDCKGLEAVRRDNCPLVANLVTASLRRLLIDRDPEGAVAHAQDVISDLLCNRIDISQLVITKELTRAASDYAGKQAHVELAERMRKRDPGSAPSLGDRVPYVIISAAKGVAAYMKSEDPLFVLEHSLPIDTQYYLEQQLAKPLLRIFEPILGEGRAEAVLLRGDHTRCKTVLTGKVGGLLAFAKRRNCCIGCRTVLSHQGAVCEFCQPRESELYQKEVSHLNALEERFSRLWTQCQRCQGSLHEDVICTSRDCPIFYMRKKVRKDLEDQEQLLRRFGPPGPEAW

SEQ ID NO: 194 - protein, 469 aa, Homo sapiens
MFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGVRFLGTSGQNVSDIFRYSSMEDHLEILEWTLRVRHISPTAPDTLGCYPFYKTDPFIFPECPHVYFCGNTPSFGSKIIRGPEDQTVLLVTVPDFSATQTACLVNLRSLACQPISFSGFGAEDDDLGGLGLGP

SEQ ID NO: 195 - protein, 172 aa, Homo sapiens
MFYHISLEHEILLHPRYFGPNLLNTVKQKLFTEVEGTCTGKYGFVIAVTTIDNIGAGVIQPGRGFVLYPVKYKAIVFRPFKGEVVDAVVTQVNKVGLFTEIGPMSCFISRHSIPSEMEFDPNSNPPCYKTMDEDIVIQQDDEIRLKIVGTRVDKNDIFAIGSLMDDYLGLVS

SEQ ID NO: 196 - protein, 346 aa, Homo sapiens
MAASQAVEEMRSRVVLGEFGVRNVHTTDFPGNYSGYDDAWDQDRFEKNFRVDVVHMDENSLEFDMVGIDAAIANAFRRILLAEVPTMAVEKVLVYNNTSIVQDEILAHRLGLIPIHADPRLFEYRNQGDEEGTEIDTLQFRLQVRCTRNPHAAKDSSDPNELYVNHKVYTRHMTWIPLGNQADLFPEGTIRPVHDDILIAQLRPGQEIDLLMHCVKGIGKDHAKFSPVATASYRLLPDITLLEPVEGEAAEELSRCFSPGVIEVQEVQGKKVARVANPRLDTFSREIFRNEKLKKVVRLARVRDHYIFSVESTGVLPPDVLVSEAIKVLMGKCRRFLDELDAVQMD

SEQ ID NO: 197 - protein, 117 aa, Homo sapiens
MNAPPAFESFLLFEGEKKITINKDTKVPNACLFTINKEDHTLGNIIKSQLLKDPQVLFAGYKVPHPLEHKIIIRVQTTPDYSPQEAFTNAITDLISELSLLEERFRVAIKDKQEGIE

SEQ ID NO: 198 - protein, 67 aa, Homo sapiens
MIIPVRCFTCGKIVGNKWEAYLGLLQAEYTEGDALDALGLKRYCCRRMLLAHVDLIEKLLNYAPLEK

SEQ ID NO: 199 - protein, 252 aa, Homo sapiens
MTPLCPRPALCYHFLTSLLRSAMQNARGARQRAEAAVLSGPGPPLGRAAQHGIPRPLSSAGRLSQGCRGASTVGAAGWKGELPKAGGSPAPGPETPAISPSKRARPAEVGGMQLRFARLSEHATAPTRGSARAAGYDLYSAYDYTIPPMEKAVVKTDIQIALPSGCYGRVAPRSGLAAKHFIDVGAGVIDEDYRGNVGVVLFNFGKEKFEVKKGDRIAQLICERIFYPEIEEVQALDDTERGSGGFGSTGKN

SEQ ID NO: 200 - protein, 481 aa, Homo sapiens
MYQASAVSLLPRDIPSCHSPSPGFSHLPTSSSQLAPDLLQFPLGQDPSFLAIPILTLPPSDSLVPPYIVWYIVWPSALISFLGCTLTVQFSNGKLQSPGNMRFTLYENKDSTNPRKRNQRILAAETDRLSYVGNNFGTGALKCNTLCRHFVGILNKTSGQMEVYDAELFNMQPLFSDVSVESELALESQTKTYREKMDSCIEAFGTTKQKRALNTRRMNRVGNESLNRAVAKAAETIIDTKGVTALVSDAIHNDLQDDSLYLPPCYDDAAKPEDVYKFEDLLSPAEYEALQSPSEAFRNVTSEEILKMIEENSHCTFVIEALKSLPSDVESRDRQARCIWFLDTLIKFRAHRVVKRKSALGPGVPHIINTKLLKHFTCLTYNNGRLRNLISDSMKAKITAYVIILALHIHDFQIDLTVLQRDLKLSEKRMMEIAKAMRLKISKRRVSVAAGSEEDHKLGTLSLPLPPAQTSDRLAKRRKIT

SEQ ID NO: 201 - protein, 466 aa, Homo sapiens
MADQLYLENIDEFVTDQNKIVTYKWLSYTLGVHVNQAKQMLYDYVERKRKENSGAQLHVTYLVSGSLIQNGHSCHKVAVVREDKLEAVKSKLAVTASIHVYSIQKAMLKDSGPLFNTDYDILKSNLQNCSKFSAIQCAAAVPRAPAESSSSSKKFEQSHLHMSSETQANNELTTNGHGPPASKQVSQQPKGIMGMFASKAAAKTQETNKETKTEAKEVTNASAAGNKAPGKGNMMSNFFGKAAMNKFKVNLDSEQAVKEEKIVEQPTVSVTEPKLATPAGLKKSSKKAEPVKVLQKEKKRGKRVALSDDETKETENMRKKRRRIKLPESDSSEDEVFPDSPGAYEAESPSPPPPPSPPLEPVPKTEPEPPSVKSSSGENKRKRKRVLKSKTYLDGEGCIVTEKVYESESCTDSEEELNMKTSSVHRPPAMTVKKEPREERKGPKKGTAALGKANRQVSITGFFQRK

SEQ ID NO: 202 - protein, 711 aa, Homo sapiens
MATSSMSKGCFVFKPNSKKRKISLPIEDYFNKGKNEPEDSKLRFETYQLIWQQMKSENERLQEELNKNLFDNLIEFLQKSHSGFQKNSRDLGGQIKLREIPTAALVLGVNVTDHDLTFGSLTEALQNNVTPYVVSLQAKDCPDMKHFLQKLISQLMDCCVDIKSKEEESVHVTQRKTHYSMDSLSSWYMTVTQKTDPKMLSKKRTTSSQWQSPPVVVILKDMESFATKVLQDFIIISSQHLHEFPLILIFGIATSPIIIHRLLPHAVSSLLCIELFQSLSCKEHLTTVLDKLLLTTQFPFKINEKVLQVLTNIFLYHDFSVQNFIKGLQLSLLEHFYSQPLSVLCCNLPEAKRRINFLSNNQCENIRRLPSFRRYVEKQASEKQVALLTNERYLKEETQLLLENLHVYHMNYFLVLRCLHKFTSSLPKYPLGRQIRELYCTCLEKNIWDSEEYASVLQLLRMLAKDELMTILEKCFKVFKSYCENHLGSTAKRIEEFLAQFQSLDETKEEEDASGSQPKGLQKTDLYHLQKSLLEMKELRRSKKQTKFEVLRENVVNFIDCLVREYLLPPETQPLHEVVYFSAAHALREHLNAAPRIALHTALNNPYYYLKNEALKSEEGCIPNIAPDICIAYKLHLECSRLINLVDWSEAFATVVTAAEKMDANSATSEEMNEIIHARFIRAVSELELLGFIKPTKQKTDHVARLTWGGC

SEQ ID NO: 203 - protein, 1233 aa, Homo sapiens
MGFLKLIEIENFKSYKGRQIIGPFQRFTAIIGPNGSGKSNLMDAISFVLGEKTSNLRVKTLRDLIHGAPVGKPAANRAFVSMVYSEEGAEDRTFARVIVGGSSEYKINNKVVQLHEYSEELEKLGILIKARNFLVFQGAVESIAMKNPKERTALFEEISRSGELAQEYDKRKKEMVKAEEDTQFNYHRKKNIAAERKEAKQEKEEADRYQRLKDEVVRAQVQLQLFKLYHNEVEIEKLNKELASKNKEIEKDKKRMDKVEDELKEKKKELGKMMREQQQIEKEIKEKDSELNQKRPQYIKAKENTSHKIKKLEAAKKSLQNAQKHYKKRKGDMDELEKEMLSVEKARQEFEERMEEESQSQGRDLTLEENQVKKYHRLKEEASKRAATLAQELEKFNRDQKADQDRLDLEERKKVETEAKIKQKLREIEENQKRIEKLEEYITTSKQSLEEQKKLEGELTEEVEMAKRRIDEINKELNQVMEQLGDARIDRQESSRQQRKAEIMESIKRLYPGSVYGRLIDLCQPTQKKYQIAVTKVLGKNMDAIIVDSEKTGRDCIQYIKEQRGEPETFLPLDYLEVKPTDEKLRELKGAKLVIDVIRYEPPHIKKALQYACGNALVCDNVEDARRIAFGGHQRHKTVALDGTLFQKSGVISGGASDLKAKARRWDEKAVDKLKEKKERLTEELKEQMKAKRKEAELRQVQSQAHGLQMRLKYSQSDLEQTKTRHLALNLQEKSKLESELANFGPRINDIKRIIQSREREMKDLKEKMNQVEDEVFEEFCREIGVRNIREFEEEKVKRQNEIAKKRLEFENQKTRLGIQLDFEKNQLKEDQDKVHMWEQTVKKDENEIEKLKKEEQRHMKIIDETMAQLQDLKNQHLAKKSEVNDKNHEMEEIRKKLGGANKEMTHLQKEVTAIETKLEQKRSDRHNLLQACKMQDIKLPLSKGTMDDISQEEGSSQGEDSVSGSQRISSIYAREALIEIDYGDLCEDLKDAQAEEEIKQEMNTLQQKLNEQQSVLQRIAAPNMKAMEKLESVRDKFQETSDEFEAARKRAKKAKQAFEQIKKERFDRFNACFESVATNIDEIYKALSRNSSAQAFLGPENPEEPYLDGINYNCVAPGKRFRPMDNLSGGEKTVAALALLFAIHSYKPAPFFVLDEIDAALDNTNIGKVANYIKEQSTCNFQAIVISLKEEFYTKAESLIGVYPEQGDCVISKVLTFDLTKYPDANPNPNEQ

SEQ ID NO: 204 - protein, 808 aa, Homo sapiens
MAGTVVLDDVELREAQRDYLDFLDDEEDQGIYQSKVRELISDNQYRLIVNVNDLRRKNEKRANRLLNNAFEELVAFQRALKDFVASIDATYAKQYEEFYVGLEGSFGSKHVSPRTLTSCFLSCVVCVEGIVTKCSLVRPKVVRSVHYCPATKKTIERRYSDLTTLVAFPSSSVYPTKDEENNPLETEYGLSVYKDHQTITIQEMPEKAPAGQLPRSVDVILDDDLVDKAKPGDRVQVVGTYRCLPGKKGGYTSGTFRTVLIACNVKQMSKDAQPSFSAEDIAKIKKFSKTRSKDIFDQLAKSLAPSIHGHDYVKKAILCLLLGGVERDLENGSHIRGDINILLIGDPSVAKSQLLRYVLCTAPRAIPTTGRGSSGVGLTAAVTTDQETGERRLEAGAMVLADRGVVCIDEFDKMSDMDRTAIHEVMEQGRVTIAKAGIHARLNARCSVLAAANPVYGRYDQYKTPMENIGLQDSLLSRFDLLFIMLDQMDPEQDREISDHVLRMHRYRAPGEQDGDAMPLGSAVDILATDDPNFSQEDQQDTQIYEKHDNLLHGTKKKKEKMVSAAFMKKYIHVAKIIKPVLTQESATYIAEEYSRLRSQDSMSSDTARTSPVTARTLETLIRLATAHAKARMSKTVDLQDAEEAVELVQYAYFKKVLEKEKKRKKRSEDESETEDEEEKSQEDQEQKRKRRKTRQPDAKDGDSYDPYDFSDTEEEMPQVHTPKTADSQETKESQKVELSESRLKAFKVALLDVFREAHAQSIGMNRLTESINRDSEEPFSSVEIQAALSKMQDDNQVMVSEGIIFLI

SEQ ID NO: 205 - protein, 821 aa, Homo sapiens
MDLAAAAEPGAGSQHLEVRDEVAEKCQKLFLDFLEEFQSSDGEIKYLQLAEELIRPERNTLVVSFVDLEQFNQQLSTTIQEEFYRVYPYLCRALKTFVKDRKEIPLAKDFYVAFQDLPTRHKIRELTSSRIGLLTRISGQVVRTHPVHPELVSGTFLCLDCQTVIRDVEQQFKYTQPNICRNPVCANRRRFLLDTNKSRFVDFQKVRIQETQAELPRGSIPRSLEVILRAEAVESAQAGDKCDFTGTLIVVPDVSKLSTPGARAETNSRVSGVDGYETEGIRGLRALGVRDLSYRLVFLACCVAPTNPRFGGKELRDEEQTAESIKNQMTVKEWEKVFEMSQDKNLYHNLCTSLFPTIHGNDEVKRGVLLMLFGGVPKTTGEGTSLRGDINVCIVGDPSTAKSQFLKHVEEFSPRAVYTSGKASSAAGLTAAVVRDEESHEFVIEAGALMLADNGVCCIDEFDKMDVRDQVAIHEAMEQQTISITKAGVKATLNARTSILAAANPISGHYDRSKSLKQNINLSAPIMSRFDLFFILVDECNEVTDYAIARRIVDLHSRIEESIDRVYSLDDIRRYLLFARQFKPKISKESEDFIVEQYKHLRQRDGSGVTKSSWRITVRQLESMIRLSEAMARMHCCDEVQPKHVKEAFRLLNKSIIRVETPDVNLDQEEEIQMEVDEGAGGINGHADSPAPVNGINGYNEDINQESAPKASLRLGFSEYCRISNLIVLHLRKVEEEEDESALKRSELVNWYLKEIESEIDSEEELINKKRIIEKVIHRLTHYDHVLIELTQAGLKGSTEGSESYEEDPYLVVNPNYLLED

SEQ ID NO: 206 - protein, 566 aa, Homo sapiens
MFVSDFRKEFYEVVQSQRVLLFVASDVDALCACKILQALFQCDHVQYTLVPVSGWQELETAFLEHKEQFHYFILINCGANVDLLDILQPDEDTIFFVCDTHRPVNVVNVYNDTQIKLLIKQDDDLEVPAYEDIFRDEEEDEEHSGNDSDGSEPSEKRTRLEEEIVEQTMRRRQRREWEARRRDILFDYEQYEYHGTSSAMVMFELAWMLSKDLNDMLWWAIVGLTDQWVQDKITQMKYVTDVGVLQRHVSRHNHRNEDEENTLSVDCTRISFEYDLRLVLYQHWSLHDSLCNTSYTAARFKLWSVHGQKRLQEFLADMGLPLKQVKQKFQAMDISLKENLREMIEESANKFGMKDMRVQTFSIHFGFKHKFLASDVVFATMSLMESPEKDGSGTDHFIQALDSLSRSNLDKLYHGLELAKKQLRATQQTIASCLCTNLVISQGPFLYCSLMEGTPDVMLFSRPASLSLLSKHLLKSFVCSTKNRRCKLLPLVMAAPLSMEHGTVTVVGIPPETDSSDRKNFFGRAFEKAAESTSSRMLHNHFDLSVIELKAEDRSKFLDALISLLS

SEQ ID NO: 207 - protein, 185 aa, Homo sapiens
MTTPNKTPPGADPKQLERTGTVREIGSQAVWSLSSCKPGFGVDQLRDDNLETYWQSDGSQPHLVNIQFRRKTTVKTLCIYADYKSDESYTPSKISVRVGNNFHNLQEIRQLELVEPSGWIHVPLTDNHKKPTRTFMIQIAVLANHQNGRDTHMRQIKIYTPVEESSIGKFPRCTTIDFMMYRSIR

SEQ ID NO: 208 - protein, 159 aa, Homo sapiens
MTLEEVRGQDTVPESTARMQGAGKALHELLLSAQRQGCLTAGVYESAKVLNVDPDNVTFCVLAAGEEDEGDIALQIHFTLIQAFCCENDIDIVRVGDVQRLAAIVGAGEEAGAPGDLHCILISNPNEDAWKDPALEKLSLFCEESRSVNDWVPSITLPE

SEQ ID NO: 209 - protein, 631 aa, Homo sapiens
MFYAHFVLSKRGPLAKIWLAAHWDKKLTKAHVFECNLESSVESIISPKVKMALRTSGHLLLGVVRIYHRKAKYLLADCNEAFIKIKMAFRPGVVDLPEENREAAYNAITLPEEFHDFDQPLPDLDDIDVAQQFSLNQSRVEEITMREEVGNISILQENDFGDFGMDDREIMREGSAFEDDDMLVSTTTSNLLLESEQSTSNLNEKINHLEYEDQYKDDNFGEGNDGGILDDKLISNNDGGIFDDPPALSEAGVMLPEQPAHDDMDEDDNVSMGGPDSPDSVDPVEPMPTMTDQTTLVPNEEEAFALEPIDITVKETKAKRKRKLIVDSVKELDSKTIRAQLSDYSDIVTTLDLAPPTKKLMMWKETGGVEKLFSLPAQPLWNNRLLKLFTRCLTPLVPEDLRKRRKGGEADNLDEFLKEFENPEVPREDQQQQHQQRDVIDEPIIEEPSRLQESVMEASRTNIDESAMPPPPPQGVKRKAGQIDPEPVMPPQQVEQMEIPPVELPPEEPPNICQLIPELELLPEKEKEKEKEKEDDEEEEDEDASGGDQDQEERRWNKRTQQMLHGLQRALAKTGAESISLLELCRNTNRKQAAAKFYSFLVLKKQQAIELTQEEPYSDIIATPGPRFHII

SEQ ID NO: 210 - protein, 437 aa, Homo sapiens
MLQGPRALASAAGQTPKVVPAMSPTELWPSGLSSPQLCPATATYYTPLYPQTAPPAAAPGTCLDATPHGPEGQVVRCLPAGRLPAKRKLDLEGIGRPVVPEFPTPKGKCIRVDGLPSPKTPKSPGEKTRYDTSLGLLTKKFIYLLSESEDGVLDLNWAAEVLDVQKRRIYDITNVLEGIQLIRKKAKNNIQWVGRGMFEDPTRPGKQQQLGQELKELMNTEQALDQLIQSCSLSFKHLTEDKANKRLAYVTYQDIRAVGNFKEQTVIAVKAPPQTRLEVPDRTEDNLQIYLKSTQGPIEVYLCPEEVQEPDSPSEEPLPSTSTLCPSPDSAQPSSSTDPSIMEPTASSVPAPAPTPQQAPPPPSLVPLEATDSLLELPHPLLQQTEDQFLSPTLACSSPLISFSPSLDQDDYLWGLEAGEGISDLFDSYDLGDLLIN

SEQ ID NO: 211 - protein, 465 aa, Homo sapiens
MRKGIQPALEQYLVTAGGGEGAAVVAAAAAASMDKRALLASPGFAAAAAAAAAPGAYIQILTTNTSTTSCSSSLQSGAVAAGPLLPSAPGAEQTAGSLLYTTPHGPSSRAGLLQQPPALGRGGSGGGGGPPAKRRLELGESGHQYLSDGLKTPKGKGRAALRSPDSPKTPKSPSEKTRYDTSLGLLTKKFIQLLSQSPDGVLDLNKAAEVLKVQKRRIYDITNVLEGIHLIKKKSKNNVQWMGCSLSEDGGMLAQCQGLSKEVTELSQEEKKLDELIQSCTLDLKLLTEDSENQRLAYVTYQDIRKISGLKDQTVIVVKAPPETRLEVPDSIESLQIHLASTQGPIEVYLCPEETETHSPMKTNNQDHNGNIPKPASKDLASTNSGHSDCSVSMGNLSPLASPANLLQQTEDQIPSNLEGPFVNLLPPLLQEDYLLSLGEEEGISDLFDAYDLEKLPLVEDFMCS

SEQ ID NO: 212 - protein, 436 aa, Homo sapiens
MSSRKSKSNSLIHTECLSQVQRILRERFCRQSPHSNLFGVQVQYKHLSELLKRTALHGESNSVLIIGPRGSGKTMLINHALKELMEIEEVSENVLQVHLNGLLQINDKIALKEITRQLNLENVVGDKVFGSFAENLSFLLEALKKGDRTSSCPVIFILDEFDLFAHHKNQTLLYNLFDISQSAQTPIAVIGLTCRLDILELLEKRVKSRFSHRQIHLMNSFGFPQYVKIFKEQLSLPAEFPDKVFAEKWNENVQYLSEDRSVQEVLQKHFNISKNLRSLHMLLMLALNRVTASHPFMTAVDLMEASQLCSMDSKANIVHGLSVLEICLIIAMKHLNDIYEEEPFNFQMVYNEFQKFVQRKAHSVYNFEKPVVMKAFEHLQQLELIKPMERTSGNSQREYQLMKLLLDNTQIMNALQKYPNCPTDVRQWATSSLSWL

SEQ ID NO: 213 - protein, 435 aa, Homo sapiens
MPHLENVVLCRESQVSILQSLFGERHHFSFPSIFIYGHTASGKTYVTQTLLKTLELPHVFVNCVECFTLRLLLEQILNKLNHLSSSEDGCSTEITCETFNDFVRLFKQVTTAENLKDQTVYIVLDKAEYLRDMEANLLPGFLRLQELADRNVTVLFLSEIVWEKFRPNTGCFEPFVLYFPDYSIGNLQKILSHDHPPEYSADFYAAYINILLGVFYTVCRDLKELRHLAVLNFPKYCEPVVKGEASERDTRKLWRNIEPHLKKAMQTVYLREISSSQWEKLQKDDTDPGQLKGLSAHTHVELPYYSKFILIAAYLASYNPARTDKRFFLKHHGKIKKTNFLKKHEKTSNHLLGPKPFPLDRLLAILYSIVDSRVAPTANIFSQITSLVTLQLLTLVGHDDQLDGPKYKCTVSLDFIRAIARTVNFDIIKYLYDFL

SEQ ID NO: 214 - protein, 85 aa, Homo sapiens
MLRRKPTRLELKLDDIEEFENIRKDLETRKKQKEDVEVVGGSDGEGAIGLSSDPKSREQMINDRIGYKPQPKPNNRSSQFGSLEF

SEQ ID NO: 215 - protein, 734 aa, Homo sapiens
MSGFDDPGIFYSDSFGGDAQADEGQARKSQLQRRFKEFLRQYRVGTDRTGFTFKYRDELKRHYNLGEYWIEVEMEDLASFDEDLADYLYKQPAEHLQLLEEAAKEVADEVTRPRPSGEEVLQDIQVMLKSDASPSSIRSLKSDMMSHLVKIPGIIIAASAVRAKATRISIQCRSCRNTLTNIAMRPGLEGYALPRKCNTDQAGRPKCPLDPYFIMPDKCKCVDFQTLKLQELPDAVPHGEMPRHMQLYCDRYLCDKVVPGNRVTIMGIYSIKKFGLTTSRGRDRVGVGIRSSYIRVLGIQVDTDGSGRSFAGAVSPQEEEEFRRLAALPNVYEVISKSIAPSIFGGTDMKKAIACLLFGGSRKRLPDGLTRRGDINLLMLGDPGTAKSQLLKFVEKCSPIGVYTSGKGSSAAGLTASVMRDPSSRNFIMEGGAMVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGVEGFTSQEDQEMLSRIEKQLKRRFAIGSQVSEHSIIKDFTKQKYPEHAIHKVLQLMLRRGEIQHRMQRKVLYRLK

SEQ ID NO: 216 - protein, 1231 aa, Homo sapiens
MIAAPEIPTDFNLLQESETHFSSDTDFEDIEGKNQKQGKGKTCKKGKKGPAEKGKGGNGGGKPPSGPNRMNGHHQQNGVENMMLFEVVKMGKSAMQSVVDDWIESYKHDRDIALLDLINFFIQCSGCKGVVTAEMFRHMQNSEIIRKMTEEFDEDSGDYPLTMAGPQWKKFKSSFCEFIGVLVRQCQYSIIYDEYMMDTVISLLTGLSDSQVRAFRHTSTLAAMKLMTALVNVALNLSINMDNTQRQYEAERNKMIGKRANERLELLLQKRKELQENQDEIENMMNAIFKGVFVHRYRDAIAEIRAICIEEIGIWMKMYSDAFLNDSYLKYVGWTMHDKQGEVRLKCLTALQGLYYNKELNSKLELFTSRFKDRIVSMTLDKEYDVAVQAIKLLTLVLQSSEEVLTAEDCENVYHLVYSAHRPVAVAAGEFLYKKLFSRRDPEEDGMMKRRGRQGPNANLVKTLVFFFLESELHEHAAYLVDSMWDCATELLKDWECMNSLLLEEPLSGEEALTDRQESALIEIMLCTIRQAAECHPPVGRGTGKRVLTAKEKKTQLDDRTKITELFAVALPQLLAKYSVDAEKVTNLLQLPQYFDLEIYTTGRLEKHLDALLRQIRNIVEKHTDTDVLEACSKTYHALCNEEFTIFNRVDISRSQLIDELADKFNRLLEDFLQEGEEPDEDDAYQVLSTLKRITAFHNAHDLSKWDLFACNYKLLKTGIENGDMPEQIVIHALQCTHYVILWQLAKITESSSTKEDLLRLKKQMRVFCQICQHYLTNVNTTVKEQAFTILCDILMIFSHQIMSGGRDMLEPLVYTPDSSLQSELLSFILDHVFIEQDDDNNSADGQQEDEASKIEALHKRRNLLAAFCKLIVYTVVEMNTAADIFKQYMKYYNDYGDIIKETMSKTRQIDKIQCAKTLILSLQQLFNEMIQENGYNFDRSSSTFSGIKELARRFALTFGLDQLKTREAIAMLHKDGIEFAFKEPNPQGESHPPLNLAFLDILSEFSSKLLRQDKRTVYVYLEKFMTFQMSLRREDVWLPLMSYRNSLLAGGDDDTMSVISGISSRGSTVRSKKSKPSTGKRKVVEGMQLSLTEESSSSDSMWLSREQTLHTPVMMQTPQLTSTIMREPKRLRPEDSFMSVYPMQTEHHQTPLDYNRRGTSLMEDDEEPIVEDVMMSSEGRIEDLNEGMDFDTMDIDLPPSKNRRERTELKPDFFDPASIMDESVLGVSMF

SEQ ID NO: 217 - protein, 354 aa, Homo sapiens
MEVEAVCGGAGEVEAQDSDPAPAFSKAPGSAGHYELPWVEKYRPVKLNEIVGNEDTVSRLEVFAREGNVPNIIIAGPPGTGKTTSILCLARALLGPALKDAMLELNASNDRGIDVVRNKIKMFAQQKVTLPKGRHKIIILDEADSMTDGAQQALRRTMEIYSKTTRFALACNASDKIIEPIQSRCAVLRYTKLTDAQILTRLMNVIEKERVPYTDDGLEAIIFTAQGDMRQALNNLQSTFSGFGFINSENVFKVCDEPHPLLVKEMIQHCVNANIDEAYKILAHLWHLGYSPEDIIGNIFRVCKTFQMAEYLKLEFIKEIGYTHMKIAEGVNSLLQMAGLLARLCQKTMAPVAS

SEQ ID NO: 218 - protein, 363 aa, Homo sapiens
MQAFLKGTSISTKPPLTKDRGVAASAGSSGENKKAKPVPWVEKYRPKCVDEVAFQEEVVAVLKKSLEGADLPNLLFYGPPGTGKTSTILAAARELFGPELFRLRVLELNASDERGIQVVREKVKNFAQLTVSGSRSDGKPCPPFKIVILDEADSMTSAAQAALRRTMEKESKTTRFCLICNYVSRIIEPLTSRCSKFRFKPLSDKIQQQRLLDIAKKENVKISDEGIAYLVKVSEGDLRKAITFLQSATRLTGGKEITEKVITDIAGVIPAEKIDGVFAACQSGSFDKLEAVVKDLIDEGHAATQLVNQLHDVVVENNLSDKQKSIITEKLAEVDKCLADGADEHLQLISLCATVMQQLSQNC

SEQ ID NO: 219 - protein, 340 aa, Homo sapiens
METSALKQQEQPAATKIRNLPWVEKYRPQTLNDLISHQDILSTIQKFINEDRLPHLLLYGPPGTGKTSTILACAKQLYKDKEFGSMVLELNASDDRGIDIIRGPILSFASTRTIFKKGFKLVILDEADAMTQDAQNALRRVIEKFTENTRFCLICNYLSKIIPALQSRCTRFRFGPLTPELMVPRLEHVVEEEKVDISEDGMKALVTLSSGDMRRALNILQSTNMAFGKVTEETVYTCTGHPLKSDIANILDWMLNQDFTTAYRNITELKTLKGLALHDILTEIHLFVHRVDFPSSVRIHLLTKMADIEYRLSVGTNEKIQLSSLIAAFQVTRDLIVAEA

SEQ ID NO: 220 - protein, 270 aa, Homo sapiens
MWNSGFESYGSSSYGGAGGYTQSPGGFGSPAPSQAEKKSRARAQHIVPCTISQLLSATLVDEVFRIGNVEISQVTIVGIIRHAEKAPTNIVYKIDDMTAAPMDVRQWVDTDDTSSENTVVPPETYVKVAGHLRSFQNKKSLVAFKIMPLEDMNEFTTHILEVINAHMVLSKANSQPSAGRAPISNPGMSEAGNFGGNSFMPANGLTVAQNQVLNLIKACPRPEGLNFQDLKNQLKHMSVSSIKQAVDFLSNEGHIYSTVDDDHFKSTDAE

SEQ ID NO: 221 - protein, 121 aa, Homo sapiens
MVDMMDLPRSRINAGMLAQFIDKPVCFVGRLEKIHPTGKMFILSDGEGKNGTIELMEPLDEEISGIVEVVGRVTAKATILCTSYVQFKEDSHPFDLGLYNEAVKIIHDFPQFYPLGIVQHD

SEQ ID NO: 222 - protein, 427 aa, Homo sapiens
MAPKKRPETQKTSEIVLRPRNKRSRSPLELEPEAKKLCAKGSGPSRRCDSDCLWVGLAGPQILPPCRSIVRTLHQHKLGRASWPSVQQGLQQSFLHTLDSYRILQKAAPFDRRATSLAWHPTHPSTVAVGSKGGDIMLWNFGIKDKPTFIKGIGAGGSITGLKFNPLNTNQFYASSMEGTTRLQDFKGNILRVFASSDTINIWFCSLDVSASSRMVVTGDNVGNVILLNMDGKELWNLRMHKKKVTHVALNPCCDWFLATASVDQTVKIWDLRQVRGKASFLYSLPHRHPVNAACFSPDGARLLTTDQKSEIRVYSASQWDCPLGLIPHPHRHFQHLTPIKAAWHPRYNLIVVGRYPDPNFKSCTPYELRTIDVFDGNSGKMMCQLYDPESSGISSLNEFNPMGDTLASAMGYHILIWSQEEARTRK

SEQ ID NO: 223 - protein, 238 aa, Homo sapiens
MSEDLAKQLASYKAQLQQVEAALSGNGENEDLLKLKKDLQEVIELTKDLLSTQPSETLASSDSFASTQPTHSWKVGDKCMAVWSEDGQCYEAEIEEIDEENGTAAITFAGYGNAEVTPLLNLKPVEEGRKAKEDSGNKPMSKKEMIAQQREYKKKKALKKAQRIKELEQEREDQKVKWQQFNNRAYSKNKKGQVKRSIFASPESVTGKVGVGTCGIADKPMTQYQDTSKYNVRHLMPQ

SEQ ID NO: 224 - protein, 793 aa, Homo sapiens
MPAGPVQAVPPPPPVPTEPKQPTEEEASSKEDSAPSKPVVGIIYPPPEVRNIVDKTASFVARNGPEFEARIRQNEINNPKFNFLNPNDPYHAYYRHKVSEFKEGKAQEPSAAIPKVMQQQQQTTQQQLPQKVQAQVIQETIVPKEPPPEFEFIADPPSISAFDLDVVKLTAQFVARNGRQFLTQLMQKEQRNYQFDFLRPQHSLFNYFTKLVEQYTKILIPPKGLFSKLKKEAENPREVLDQVCYRVEWAKFQERERKKEEEEKEKERVAYAQIDWHDFVVVETVDFQPNEQGNFPPPTTPEELGARILIQERYEKFGESEEVEMEVESDEEDDKQEKAEEPPSQLDQDTQVQDMDEGSDDEEEGQKVPPPPETPMPPPLPPTPDQVIVRKDYDPKASKPLPPAPAPDEYLVSPITGEKIPASKMQEHMRIGLLDPRWLEQRDRSIREKQSDDEVYAPGLDIESSLKQLAERRTDIFGVEETAIGKKIGEEEIQKPEEKVTWDGHSGSMARTQQAAQANITLQEQIEAIHKAKGLVPEDDTKEKIGPSKPNEIPQQPPPPSSATNIPSSAPPITSVPRPPTMPPPVRTTVVSAVPVMPRPPMASVVRLPPGSVIAPMPPIIHAPRINVVPMPPSAPPIMAPRPPPMIVPTAFVPAPPVAPVPAPAPMPPVHPPPPMEDEPTSKKLKTEDSLMPEEEFLRRNKGPVSIKVQVPNMQDKTEWKLNGQVLVFTLPLTDQVSVIKVKIHEATGMPAGKQKLQYEGIFIKDSNSLAYYNMANGAVIHLALKERGGRKK

SEQ ID NO: 225 - protein, 475 aa, Homo sapiens
MSDFDEFERQLNENKQERDKENRHRKRSHSRSRSRDRKRRSRSRDRRNRDQRSASRDRRRRSKPLTRGAKEEHGGLIRSPRHEKKKKVRKYWDVPPPGFEHITPMQYKAMQAAGQIPATALLPTMTPDGLAVTPTPVPVVGSQMTRQARRLYVGNIPFGITEEAMMDFFNAQMRLGGLTQAPGNPVLAVQINQDKNFAFLEFRSVDETTQAMAFDGIIFQGQSLKIRRPHDYQPLPGMSENPSVYVPGVVSTVVPDSAHKLFIGGLPNYLNDDQVKELLTSFGPLKAFNLVKDSATGLSKGYAFCEYVDINVTDQAIAGLNGMQLGDKKLLVQRASVGAKNATLVSPPSTINQTPVTLQVPGLMSSQVQMGGHPTEVLCLMNMVLPEELLDDEEYEEIVEDVRDECSKYGLVKSIEIPRPVDGVEVPGCGKIFVEFTSVFDCQKAMQGLTGRKFANRVVVTKYCDPDSYHRRDFW

SEQ ID NO: 226 - protein, 91 aa, Homo sapiens
MAANATTNPSQLLPLELVDKCIGSRIHIVMKSDKEIVGTLLGFDDFVNMVLEDVTEFEITPEGRRITKLDQILLNGNNITMLVPGGEGPEV

SEQ ID NO: 227 - protein, 825 aa, Homo sapiens
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGKKKAEGGGGGGRPGAPAAGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEESKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGQFWGQKPWSQHYHQGYY

SEQ ID NO: 228 - protein, 372 aa, Homo sapiens
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGGYGGGGPGYSGGSRGYGSGGQGYGNQGSGYGGSGSYDSYNNGGGGGFGGGSGSNFGGGGSYNDFGNYNNQSSNFGPMKGGNFGGRSSGPYGGGGQYFAKPRNQGGYGGSSSSSSYGSGRRF

SEQ ID NO: 229 - protein, 501 aa, Homo sapiens
METILEQQRRYHEEKERLMDVMAKEMLTKKSTLRDQINSDHRTRAMQDRYMEVSGNLRDLYDDKDGLRKEELNAISGPNEFAEFYNRLKQIKEFHRKHPNEICVPMSVEFEELLKARENPSEEAQNLVEFTDEEGYGRYLDLHDCYLKYINLKASEKLDYITYLSIFDQLFDIPKERKNAEYKRYLEMLLEYLQDYTDRVKPLQDQNELFGKIQAEFEKKWENGTFPGWPKETSSALTHAGAHLDLSAFSSWEELASLGLDRLKSALLALGLKCGGTLEERAQRLFSTKGKSLESLDTSLFAKNPKSKGTKRDTERNKDIAFLEAQIYEYVEILGEQRHLTHENVQRKQARTGEEREEEEEEQISESESEDEENEIIYNPKNLPLGWDGKPIPYWLYKLHGLNINYNCEICGNYTYRGPKAFQRHFAEWRHAHGMRCLGIPNTAHFANVTQIEDAVSLWAKLKLQKASERWQPDTEEEYEDSSGNVVNKKTYEDLKRQGLL

SEQ ID NO: 230 - protein, 164 aa, Homo sapiens
MHRDSCPLDCKVYVGNLGNNGNKTELERAFGYYGPLRSVWVARNPPGFAFVEFEDPRDAADAVRELDGRTLCGCRVRVELSNGEKRSRNRGPPPSWGRRPRDDYRRRSPPPRRRSPRRRSFSRSRSRSLSRDRRRERSLSRERNHKPSRSFSRSRSRSRSNERK

SEQ ID NO: 231 - protein, 238 aa, Homo sapiens
MSRYGRYGGETKVYVGNLGTGAGKGELERAFSYYGPLRTVWIARNPPGFAFVEFEDPRDAEDAVRGLDGKVICGSRVRVELSTGMPRRSRFDRPPARRPFDPNDRCYECGEKGHYAYDCHRYSRRRRSRSRSRSHSRSRGRRYSRSRSRSRGRRSRSASPRRSRSISLRRSRSASLRRSRSGSIKGSRYFQSPSRSRSRSRSISRPRSSRSKSRSPSPKRSRSPSGSPRRSASPERMD

SEQ ID NO: 232 - protein, 288 aa, Homo sapiens
MSDSGEQNYGERESRSASRSGSAHGSGKSARHTPARSRSKEDSRRSRSKSRSRSESRSRSRRSSRRHYTRSRSRSRSHRRSRSRSYSRDYRRRHSHSHSPMSTRRRHVGNRANPDPNCCLGVFGLSLYTTERDLREVFSKYGPIADVSIVYDQQSRRSRGFAFVYFENVDDAKEAKERANGMELDGRRIRVDFSITKRPHTPTPGIYMGRPTYGSSRRRDYYDRGYDRGYDDRDYYSRSYRGGGGGGGGWRAAQDRDQIYRRRSPSPYYSRGGYRSRSRSRSYSPRRY

SEQ ID NO: 233 - protein, 2335 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 234 - protein, 86 aa, Homo sapiens
MSLPLNPKPFLNGLTGKPVMVKLKWGMEYKGYLVSVDGYMNMQLANTEEYIDGALSGHLGEVLIRCNNVLYIRGVEEEEEDGEMRE

SEQ ID NO: 235 - protein, 255 aa, Homo sapiens
MVKLTAELIEQAAQYTNAVRDRELDLRGYKIPVIENLGATLDQFDAIDFSDNEIRKLDGFPLLRRLKTLLVNNNRICRIGEGLDQALPCLTELILTNNSLVELGDLDPLASLKSLTYLSILRNPVTNKKHYRLYVIYKVPQVRVLDFQKVKLKERQEAEKMFKGKRGAQLAKDIARRSKTFNPGAGLPTDKKKGGPSPGDVEAIKNAIANASTLAEVERLKGLLQSGQIPGRERRSGPTDDGEEEMEEDTVTNGS

SEQ ID NO: 236 - protein, 118 aa, Homo sapiens
MSLLNKPKSEMTPEELQKREEEEFNTGPLSVLTQSVKNNTQVLINCRNNKKLLGRVKAFDRHCNMVLENVKEMWTEVPKSGKGKKKSKPVNKDRYISKMFLRGDSVIVVLRNPLIAGK

SEQ ID NO: 237 - protein, 103 aa, Homo sapiens
MADKEKKKKESILDLSKYIDKTIRVKFQGGREASGILKGFDPLLNLVLDGTIEYMRDPDDQYKLTEDTRQLGLVVCRGTSVVLICPQDGMEAIPNPFIQQQDA

SEQ ID NO: 238 - protein, 464 aa, Homo sapiens
MDFQHRPGGKTGSGGVASSSESNRDRRERLRQLALETIDINKDPYFMKNHLGSYECKLCLTLHNNEGSYLAHTQGKKHQTNLARRAAKEAKEAPAQPAPEKVKVEVKKFVKIGRPGYKVTKQRDSEMGQQSLLFQIDYPEIAEGIMPRHRFMSAYEQRIEPPDRRWQYLLMAAEPYETIAFKVPSREIDKAEGKFWTHWNRETKQFFLQFHFKMEKPPAPPSLPAGPPGVKRPPPPLMNGLPPRPPLPESLPPPPPGGLPLPPMPPTGPAPSGPPGPPQLPPPAPGVHPPAPVVHPPASGVHPPAPGVHPPAPGVHPPAPGVHPPTSGVHPPAPGVHPPAPGVHPPAPGVHPPAPGVHPPAPGVHPPPSAGVHPQAPGVHPAAPAVHPQAPGVHPPAPGMHPQAPGVHPQPPGVHPSAPGVHPQPPGVHPSNPGVHPPTPMPPMLRPPLPSEGPGNIPPPPPTN

SEQ ID NO: 239 - protein, 86 aa, Homo sapiens
MTDRYTIHSQLEHLQSKYIGTGHADTTKWEWLVNQHRDSYCSYMGHFDLLNYFAIAENESKARVRFNLMEKMLQPCGPPADKPEEN

SEQ ID NO: 240 - protein, 708 aa, Homo sapiens
MSTADALDDENTFKILVATDIHLGFMEKDAVRGNDTFVTLDEILRLAQENEVDFILLGGDLFHENKPSRKTLHTCLELLRKYCMGDRPVQFEILSDQSVNFGFSKFPWVNYQDGNLNISIPVFSIHGNHDDPTGADALCALDILSCAGFVNHFGRSMSVEKIDISPVLLQKGSTKIALYGLGSIPDERLYRMFVNKKVTMLRPKEDENSWFNLFVIHQNRSKHGSTNFIPEQFLDDFIDLVIWGHEHECKIAPTKNEQQLFYISQPGSSVVTSLSPGEAVKKHVGLLRIKGRKMNMHKIPLHTVRQFFMEDIVLANHPDIFNPDNPKVTQAIQSFCLEKIEEMLENAERERLGNSHQPEKPLVRLRVDYSGGFEPFSVLRFSQKFVDRVANPKDIIHFFRHREQKEKTGEEINFGKLITKPSEGTTLRVEDLVKQYFQTAEKNVQLSLLTERGMGEAVQEFVDKEEKDAIEELVKYQLEKTQRFLKERHIDALEDKIDEEVRRFRETRQKNTNEEDDEVREAMTRARALRSQSEESASAFSADDLMSIDLAEQMANDSDDSISAATNKGRGRGRGRRGGRGQNSASRGGSQRGRADTGLETSTRSRNSKTAVSASRNMSIIDAFKSTRQQPSRNVTTKNYSEVIEVDESDVEEDIFPTTSKTDQRWSSTSSSKIMSQSQVSKGVDFESSEDDDDDPFMNTSSLRRNRR

SEQ ID NO: 241 - protein, 1001 aa, Homo sapiens
MIFPVARYALRWLRRPEDRAFSRAAMEMALRGVRKVLCVAEKNDAAKGIADLLSNGRMRRREGLSKFNKIYEFDYHLYGQNVTMVMTSVSGHLLAHDFQMQFRKWQSCNPLVLFEAEIEKYCPENFVDIKKTLERETRQCQALVIWTDCDREGENIGFEIIHVCKAVKPNLQVLRARFSEITPHAVRTACENLTEPDQRVSDAVDVRQELDLRIGAAFTRFQTLRLQRIFPEVLAEQLISYGSCQFPTLGFVVERFKAIQAFVPEIFHRIKVTHDHKDGIVEFNWKRHRLFNHTACLVLYQLCVEDPMATVVEVRSKPKSKWRPQALDTVELEKLASRKLRINAKETMRIAEKLYTQGYISYPRTETNIFPRDLNLTVLVEQQTPDPRWGAFAQSILERGGPTPRNGNKSDQAHPPIHPTKYTNNLQGDEQRLYEFIVRHFLACCSQDAQGQETTVEIDIAQERFVAHGLMILARNYLDVYPYDHWSDKILPVYEQGSHFQPSTVEMVDGETSPPKLLTEADLIALMEKHGIGTDATHAEHIETIKARMYVGLTPDKRFLPGHLGMGLVEGYDSMGYEMSKPDLRAELEADLKLICDGKKDKFVVLRQQVQKYKQVFIEAVAKAKKLDEALAQYFGNGTELAQQEDIYPAMPEPIRKCPQCNKDMVLKTKKNGGFYLSCMGFPECRSAVWLPDSVLEASRDSSVCPVCQPHPVYRLKLKFKRGSLPPTMPLEFVCCIGGCDDTLREILDLRFSGGPPRASQPSGRLQANQSLNRMDNSQHPQPADSRQTGSSKALAQTLPPPTAAGESNSVTCNCGQEAVLLTVRKEGPNRGRQFFKCNGGSCNFFLWADSPNPGAGGPPALAYRPLGASLGCPPGPGIHLGGFGNPGDGSGSGTSCLCSQPSVTRTVQKDGPNKGRQFHTCAKPREQQCGFFQWVDENTAPGTSGAPSWTGDRGRTLESEARSKRPRASSSDMGSTAKKPRKCSLCHQPGHTRPFCPQNR

SEQ ID NO: 242 - protein, 597 aa, Homo sapiens
MAHNKIPPRWLNCPRRGQPVAGRFLPLKTMLGPRYDSQVAEENRFHPSMLSNYLKSLKVKMGLLVDLTNTSRFYDRNDIEKEGIKYIKLQCKGHGECPTTENTETFIRLCERFNERNPPELIGVHCTHGFNRTGFLICAFLVEKMDWSIEAAVATFAQARPPGIYKGDYLKELFRRYGDIEEAPPPPLLPDWCFEDDEDEDEDEDGKKESEPGSSASFGKRRKERLKLGAIFLEGVTVKGVTQVTTQPKLGEVQQKCHQFCGWEGSGFPGAQPVSMDKQNIKLLDLKPYKVSWKADGTRYMMLIDGTNEVFMIDRDNSVFHVSNLEFPFRKDLRMHLSNTLLDGEMIIDRVNGQAVPRYLIYDIIKFNSQPVGDCDFNVRLQCIEREIISPRHEKMKTGLIDKTQEPFSVRNKPFFDICTSRKLLEGNFAKEVSHEMDGLIFQPTGKYKPGRCDDILKWKPPSLNSVDFRLKITRMGGEGLLPQNVGLLYVGGYERPFAQIKVTKELKQYDNKIIECKFENNSWVFMRQRTDKSFPNAYNTAMAVCNSISNPVTKEMLFEFIDRCTAASQGQKRKHHLDPDTELMPPPPPKRPRPLT

SEQ ID NO: 243 - protein, 453 aa, Homo sapiens
MAGAGGGGCPAGGNDFQWCFSQVKGAIDEDVAEADIISTVEFNYSGDLLATGDKGGRVVIFQREQENKSRPHSRGEYNVYSTFQSHEPEFDYLKSLEIEEKINKIRWLPQQNAAHFLLSTNDKTIKLWKISERDKRAEGYNLKDEDGRLRDPFRITALRVPILKPMDLMVEASPRRIFANAHTYHINSISVNSDHETYLSADDLRINLWHLEITDRSFNIVDIKPANMEELTEVITAAEFHPHQCNVFVYSSSKGTIRLCDMRSSALCDRHSKFFEEPEDPSSRSFFSEIISSISDVKFSHSGRYMMTRDYLSVKVWDLNMESRPVETHQVHEYLRSKLCSLYENDCIFDKFECCWNGSDSAIMTGSYNNFFRMFDRDTRRDVTLEASRESSKPRASLKPRKVCTGGKRRKDEISVDSLDFNKKILHTAWHPVDNVIAVAATNNLYIFQDKIN

SEQ ID NO: 244 - protein, 1137 aa, Homo sapiens
MSLQSAQYLRQAEVLKADMTDSKLGPAEVWTSRQALQDLYQKMLVTDLEYALDKKVEQDLWNHAFKNQITTLQGQAKNRANPNRSEVQANLSLFLEAASGFYTQLLQELCTVFNVDLPCRVKSSQLGIISNKQTHTSAIVKPQSSSCSYICQHCLVHLGDIARYRNQTSQAESYYRHAAQLVPSNGQPYNQLAILASSKGDHLTTIFYYCRSIAVKFPFPAASTNLQKALSKALESRDEVKTKWGVSDFIKAFIKFHGHVYLSKSLEKLSPLREKLEEQFKRLLFQKAFNSQQLVHVTVINLFQLHHLRDFSNETEQHTYSQDEQLCWTQLLALFMSFLGILCKCPLQNESQEESYNAYPLPAVKVSMDWLRLRPRVFQEAVVDERQYIWPWLISLLNSFHPHEEDLSSISATPLPEEFELQGFLALRPSFRNLDFSKGHQGITGDKEGQQRRIRQQRLISIGKWIADNQPRLIQCENEVGKLLFITEIPELILEDPSEAKENLILQETSVIESLAADGSPGLKSVLSTSRNLSNNCDTGEKPVVTFKENIKTREVNRDQGRSFPPKEVRRDYSKGITVTKNDGKKDNNKRKTETKKCTLEKLQETGKQNVAVQVKSQTELRKTPVSEARKTPVTQTPTQASNSQFIPIHHPGAFPPLPSRPGFPPPTYVIPPPVAFSMGSGYTFPAGVSVPGTFLQPTAHSPAGNQVQAGKQSHIPYSQQRPSGPGPMNQGPQQSQPPSQQPLTSLPAQPTAQSTSQLQVQALTQQQQSPTKAVPALGKSPPHHSGFQQYQQADASKQLWNPPQVQGPLGKIMPVKQPYYLQTQDPIKLFEPSLQPPVMQQQPLEKKMKPFPMEPYNHNPSEVKVPEFYWDSSYSMADNRSVMAQQANIDRRGKRSPGVFRPEQDPVPRMPFEKSLLEKPSELMSHSSSFLSLTGFSLNQERYPNNSMFNEVYGKNLTSSSKAELSPSMAPQETSLYSLFEGTPWSPSLPASSDHSTPASQSPHSSNPSSLPSSPPTHNHNSVPFSNFGPIGTPDNRDRRTADRWKTDKPAMGGFGIDYLSATSSSESSWHQASTPSGTWTGHGPSMEDSSAVLMESLKSIWSSSMMHPGPSALEQLLMQQKQKQQRGQGTMNPPH

SEQ ID NO: 245 - protein, 407 aa, Homo sapiens
MNNSGADEIGKLFVGGLDWSTTQETLRSYFSQYGEVVDCVIMKDKTTNQSRGFGFVKFKDPNCVGTVLASRPHTLDGRNIDPKPCTPRGMQPERTRPKEGWQKGPRSDNSKSNKIFVGGIPHNCGETELREYFKKFGVVTEVVMIYDAEKQRPRGFGFITFEDEQSVDQAVNMHFHDIMGKKVEVKRAEPRDSKSQAPGQPGASQWGSRVVPNAANGWAGQPPPTWQQGYGPQGMWVPAGQAIGGYGPPPAGRGAPPPPPPFTSYIVSTPPGGFPPPQGFPQGYGAPPQFSFGYGPPPPPPDQFAPPGVPPPPATPGAAPLAFPPPPSQAAPDMSKPPTAQPDFPYGQYAGYGQDLSGFGQGFSDPSQQPPSYGGPSVPGSGGPPAGGSGFGRGQNHNVQGFHPYRR

SEQ ID NO: 246 - protein, 313 aa, Homo sapiens
MKLTDSVLRSFRVAKVFRENSDKINCFDFSPNGETVISSSDDDSIVLYDCQEGKPKRTLYSKKYGVDLIRYTHAANTVVYSSNKIDDTIRYLSLHDNKYIRYFPGHSKRVVALSMSPVDDTFISGSLDKTIRLWDLRSPNCQGLMHLQGKPVCSFDPEGLIFAAGVNSEMVKLYDLRSFDKGPFATFKMQYDRTCEWTGLKFSNDGKLILISTNGSFIRLIDAFKGVVMHTFGGYANSKAVTLEASFTPDSQFIMIGSEDGKIHVWNGESGIKVAVLDGKHTGPITCLQFNPKFMTFASACSNMAFWLPTIDD

SEQ ID NO: 247 - protein, 684 aa, Homo sapiens
MSAIPAEESDQLLIRPLGAGQEVGRSCIILEFKGRKIMLDCGIHPGLEGMDALPYIDLIDPAEIDLLLISHFHLDHCGALPWFLQKTSFKGRTFMTHATKAIYRWLLSDYVKVSNISADDMLYTETDLEESMDKIETINFHEVKEVAGIKFWCYHAGHVLGAAMFMIEIAGVKLLYTGDFSRQEDRHLMAAEIPNIKPDILIIESTYGTHIHEKREEREARFCNTVHDIVNRGGRGLIPVFALGRAQELLLILDEYWQNHPELHDIPIYYASSLAKKCMAVYQTYVNAMNDKIRKQININNPFVFKHISNLKSMDHFDDIGPSVVMASPGMMQSGLSRELFESWCTDKRNGVIIAGYCVEGTLAKHIMSEPEEITTMSGQKLPLKMSVDYISFSAHTDYQQTSEFIRALKPPHVILVHGEQNEMARLKAALIREYEDNDEVHIEVHNPRNTEAVTLNFRGEKLAKVMGFLADKKPEQGQRVSGILVKRNFNYHILSPCDLSNYTDLAMSTVKQTQAIPYTGPFNLLCYQLQKLTGDVEELEIQEKPALKVFKNITVIQEPGMVVLEWLANPSNDMYADTVTTVILEVQSNPKIRKGAVQKVSKKLEMHVYSKRLEIMLQDIFGEDCVSVKDDSILSVTVDGKTANLNLETRTVECEEGSEDDESLREMVELAAQRLYEALTPVH

SEQ ID NO: 248 - protein, 1274 aa, Homo sapiens
MASGSGDSVTRRSVASQFFTQEEGPGIDGMTTSERVVDLLNQAALITNDSKITVLKQVQELIINKDPTLLDNFLDEIIAFQADKSIEVRKFVIGFIEEACKRDIELLLKLIANLNMLLRDENVNVVKKAILTMTQLYKVALQWMVKSRVISELQEACWDMVSAMAGDIILLLDSDNDGIRTHAIKFVEGLIVTLSPRMADSEIPRRQEHDISLDRIPRDHPYIQYNVLWEEGKAALEQLLKFMVHPAISSINLTTALGSLANIARQRPMFMSEVIQAYETLHANLPPTLAKSQVSSVRKNLKLHLLSVLKHPASLEFQAQITTLLVDLGTPQAEIARNMPSSKDTRKRPRDDSDSTLKKMKLEPNLGEDDEDKDLEPGPSGTSKASAQISGQSDTDITAEFLQPLLTPDNVANLVLISMVYLPEAMPASFQAIYTPVESAGTEAQIKHLARLMATQMTAAGLGPGVEQTKQCKEEPKEEKVVKTESVLIKRRLSAQGQAISVVGSLSSMSPLEEEAPQAKRRPEPIIPVTQPRLAGAGGRKKIFRLSDVLKPLTDAQVEAMKLGAVKRILRAEKAVACSGAAQVRIKILASLVTQFNSGLKAEVLSFILEDVRARLDLAFAWLYQEYNAYLAAGASGSLDKYEDCLIRLLSGLQEKPDQKDGIFTKVVLEAPLITESALEVVRKYCEDESRTYLGMSTLRDLIFKRPSRQFQYLHVLLDLSSHEKDKVRSQALLFIKRMYEKEQLREYVEKFALNYLQLLVHPNPPSVLFGADKDTEVAAPWTEETVKQCLYLYLALLPQNHKLIHELAAVYTEAIADIKRTVLRVIEQPIRGMGMNSPELLLLVENCPKGAETLVTRCLHSLTDKVPPSPELVKRVRDLYHKRLPDVRFLIPVLNGLEKKEVIQALPKLIKLNPIVVKEVFNRLLGTQHGEGNSALSPLNPGELLIALHNIDSVKCDMKSIIKATNLCFAERNVYTSEVLAVVMQQLMEQSPLPMLLMRTVIQSLTMYPRLGGFVMNILSRLIMKQVWKYPKVWEGFIKCCQRTKPQSFQVILQLPPQQLGAVFDKCPELREPLLAHVRSFTPHQQAHIPNSIMTILEASGKQEPEAKEAPAGPLEEDDLEPLTLAPAPAPRPPQDLIGLRLAQEKALKRQLEEEQKLKPGGVGAPSSSSPSPSPSARPGPPPSEEAMDFREEGPECETPGIFISMDDDSGLTEAALLDSSLEGPLPKETAAGGLTLKEERSPQTLAPVGEDAMKTPSPAAEDAREPEAKGNS

SEQ ID NO: 249 - protein, 950 aa, Homo sapiens
MGVPAFFRWLSRKYPSIIVNCVEEKPKECNGVKIPVDASKPNPNDVEFDNLYLDMNGIIHPCTHPEDKPAPKNEDEMMVAIFEYIDRLFSIVRPRRLLYMAIDGVAPRAKMNQQRSRRFRASKEGMEAAVEKQRVREEILAKGGFLPPEEIKERFDSNCITPGTEFMDNLAKCLRYYIADRLNNDPGWKNLTVILSDASAPGEGEHKIMDYIRRQRAQPNHDPNTHHCLCGADADLIMLGLATHEPNFTIIREEFKPNKPKPCGLCNQFGHEVKDCEGLPREKKGKHDELADSLPCAEGEFIFLRLNVLREYLERELTMASLPFTFDVERSIDDWVFMCFFVGNDFLPHLPSLEIRENAIDRLVNIYKNVVHKTGGYLTESGYVNLQRVQMIMLAVGEVEDSIFKKRKDDEDSFRRRQKEKRKRMKRDQPAFTPSGILTPHALGSRNSPGSQVASNPRQAAYEMRMQNNSSPSISPNTSFTSDGSPSPLGGIKRKAEDSDSEPEPEDNVRLWEAGWKQRYYKNKFDVDAADEKFRRKVVQSYVEGLCWVLRYYYQGCASWKWYYPFHYAPFASDFEGIADMPSDFEKGTKPFKPLEQLMGVFPAASGNFLPPSWRKLMSDPDSSIIDFYPEDFAIDLNGKKYAWQGVALLPFVDERRLRAALEEVYPDLTPEETRRNSLGGDVLFVGKHHPLHDFILELYQTGSTEPVEVPPELCHGIQGKFSLDEEAILPDQIVCSPVPMLRDLTQNTVVSINFKDPQFAEDYIFKAVMLPGARKPAAVLKPSDWEKSSNGRQWKPQLGFNRDRRPVHLDQAAFRTLGHVMPRGSGTGIYSNAAPPPVTYQGNLYRPLLRGQAQIPKLMSNMRPQDSWRGPPPLFQQQRFDRGVGAEPLLPWNRMLQTQNAAFQPNQYQMLAGPGGYPPRRDDRGGRQGYPREGRKYPLPPPSGRYNWN

SEQ ID NO: 250 - protein, 744 aa, Homo sapiens
MAADKPADQGAEKHEGTGQSSGITDQEKELSTNAFQAFTSGNYDACLQHLACLQDINKDDYKIILNTAVAEFFKSNQTTTDNLRQTLNQLKNQVHSAVEEMDGLDDVENSMLYYNQAVILYHLRQYTEAISVGEKLYQFIEPFEEKFAQAVCFLLVDLYILTYQAEKALHLLAVLEKMISQGNNNKNGKNETGNNNNKDGSNHKAESGALIEAAKSKIHQYKVRAYIQMKSLKACKREIKSVMNTAGNSAPSLFLKSNFEYLRGNYRKAVKLLNSSNIAEHPGFMKTGECLRCMFWNNLGCIHFAMSKHNLGIFYFKKALQENDNVCAQLSAGSTDPGKKFSGRPMCTLLTNKRYELLYNCGIQLLHIGRPLAAFECLIEAVQVYHANPRLWLRLAECCIAANKGTSEQETKGLPSKKGIVQSIVGQGYHRKIVLASQSIQNTVYNDGQSSAIPVASMEFAAICLRNALLLLPEEQQDPKQENGAKNSNQLGGNTESSESSETCSSKSHDGDKFIPAPPSSPLRKQELENLKCSILACSAYVALALGDNLMALNHADKLLQQPKLSGSLKFLGHLYAAEALISLDRISDAITHLNPENVTDVSLGISSNEQDQGSDKGENEAMESSGKRAPQCYPSSVNSARTVMLFNLGSAYCLRSEYDKARKCLHQAASMIHPKEVPPEAILLAVYLELQNGNTQLALQIIKRNQLLPAVKTHSEVRKKPVFQPVHPIQPIQMPAFTTVQRK

SEQ ID NO: 251 - protein, 141 aa, Homo sapiens
MAGEEINEDYPVEIHEYLSAFENSIGAVDEMLKTMMSVSRNELLQKLDPLEQAKVDLVSAYTLNSMFWVYLATQGVNPKEHPVKQELERIRVYMNRVKEITDKKKAGKLDRGAASRFVKNALWEPKSKNASKVANKGKSKS

SEQ ID NO: 252 - protein, 434 aa, Homo sapiens
MSILKIHAREIFDSRGNPTVEVDLFTSKGLFRAAVPSGASTGIYEALELRDNDKTRYMGKGVSKAVEHINKTIAPALVSKKLNVTEQEKIDKLMIEMDGTENKSKFGANAILGVSLAVCKAGAVEKGVPLYRHIADLAGNSEVILPVPAFNVINGGSHAGNKLAMQEFMILPVGAANFREAMRIGAEVYHNLKNVIKEKYGKDATNVGDEGGFAPNILENKEGLELLKTAIGKAGYTDKVVIGMDVAASEFFRSGKYDLDFKSPDDPSRYISPDQLADLYKSFIKDYPVVSIEDPFDQDDWGAWQKFTASAGIQVVGDDLTVTNPKRIAKAVNEKSCNCLLLKVNQIGSVTESLQACKLAQANGWGVMVSHRSGETEDTFIADLVVGLCTGQIKTGAPCRSERLAKYNQLLRIEEELGSKAKFAGRNFRNPLAK

SEQ ID NO: 253 - protein, 291 aa, Homo sapiens [sequence omitted]

SEQ ID NO: 254 - protein, 293 aa, Homo sapiens
MAMEMRLPVARKPLSERLGRDTKKHLVVPGDTITTDTGFMRGHGTYMGEEKLIASVAGSVERVNKLICVKALKTRYIGEVGDIVVGRITEVQQKRWKVETNSRLDSVLLLSSMNLPGGELRRRSAEDELAMRGFLQEGDLISAEVQAVFSDGAVSLHTRSLKYGKLGQGVLVQVSPSLVKRQKTHFHDLPCGASVILGNNGFIWIYPTPEHKEEEAGGFIANLEPVSLADREVISRLRNCIISLVTQRMMLYDTSILYCYEASLPHQIKDILKPEIMEEIVMETRQRLLEQEG

SEQ ID NO: 255 - protein, 958 aa, Homo sapiens
MLKSKTFLKKTRAGGVMKIVREHYLRDDIGCGAPGCAACGGAHEGPALEPQPQDPASSVCPQPHYLLPDTNVLLHQIDVLEDPAIRNVIVLQTVLQEVRNRSAPVYKRIRDVTNNQEKHFYTFTNEHHRETYVEQEQGENANDRNDRAIRVAAKWYNEHLKKMSADNQLQVIFITNDRRNKEKAIEEGIPAFTCEEYVKSLTANPELIDRLACLSEEGNEIESGKIIFSEHLPLSKLQQGIKSGTYLQGTFRASRENYLEATVWIHGDNEENKEIILQGLKHLNRAVHEDIVAVELLPKSQWVAPSSVVLHDEGQNEEDVEKEEETERMLKTAVSEKMLKPTGRVVGIIKRNWRPYCGMLSKSDIKESRRHLFTPADKRIPRIRIETRQASTLEGRRIIVAIDGWPRNSRYPNGHFVRNLGDVGEKETETEVLLLEHDVPHQPFSQAVLSFLPKMPWSITEKDMKNREDLRHLCICSVDPPGCTDIDDALHCRELENGNLEVGVHIADVSHFIRPGNALDQESARRGTTVYLCEKRIDMVPELLSSNLCSLKCDVDRLAFSCIWEMNHNAEILKTKFTKSVINSKASLTYAEAQLRIDSANMNDDITTSLRGLNKLAKILKKRRIEKGALTLSSPEVRFHMDSETHDPIDLQTKELRETNSMVEEFMLLANISVAKKIHEEFSEHALLRKHPAPPPSNYEILVKAARSRNLEIKTDTAKSLAESLDQAESPTFPYLNTLLRILATRCMMQAVYFCSGMDNDFHHYGLASPIYTHFTSPIRRYADVIVHRLLAVAIGADCTYPELTDKHKLADICKNLNFRHKMAQYAQRASVAFHTQLFFKSKGIVSEEAYILFVRKNAIVVLIPKYGLEGTVFFEEKDKPNPQLIYDDEIPSLKIEDTVFHVFDKVKVKIMLDSSNLQHQKIRMSLVEPQIPGISIPTDTSNMDLNGPKKKKMKLGK

SEQ ID NO: 256 - protein, 329 aa, Homo sapiens
MAALGGDGLRLLSVSRPERPPESAALGGLGPGLCCWVSVFSCLSLACSYVGSLYVWKSELPRDHPAVIKRRFTSVLVVSSLSPLCVLLWRELTGIQPGTSLLTLMGFRLEGIFPAALLPLLLTMILFLGPLMQLSMDCPCDLADGLKVVLAPRSWARCLTDMRWLRNQVIAPLTEELVFRACMLPMLAPCMGLGPAVFTCPLFFGVAHFHHIIEQLRFRQSSVGNIFLSAAFQFSYTAVFGAYTAFLFIRTGHLIGPVLCHSFCNYMGFPAVCAALEHPQRRPLLAGYALGVGLFLLLLQPLTDPKLYGSLPLCVLLERAGDSEAPLCS

SEQ ID NO: 257 - protein, 293 aa, Homo sapiens
MTGLYELVWRVLHALLCLHRTLTSWLRVRFGTWNWIWRRCCRAASAAVLAPLGFTLRKPPAVGRNRRHHRHPRGGSCLAAAHHRMRWRADGRSLEKLPVHMGLVITEVEQEPSFSDIASLVVWCMAVGISYISVYDHQGIFKRNNSRLMDEILKQQQELLGLDCSKYSPEFANSNDKDDQVLNCHLAVKVLSPEDGKADIVRAAQDFCQLVAQKQKRPTDLDVDTLASLLSSNGCPDPDLVLKFGPVDSTLGFLPWHIRLTEIVSLPSHLNISYEDFFSALRQYAACEQRLGK

SEQ ID NO: 258 - protein, 227 aa, Homo sapiens
MPEINTNHLDKQQVQLLAEMCILIDENDNKIGAETKKNCHLNENIEKGLLHRAFSVFLFNTENKLLLQQRSDAKITFPGCFTNTCCSHPLSNPAELEESDALGVRRAAQRRLKAELGIPLEEVPPEEINYLTRIHYKAQSDGIWGEHEIDYILLVRKNVTLNPDPNEIKSYCYVSKEELKELLKKAASGEIKITPWFKIIAATFLFKWWDNLNHLNQFVDHEKIYRM

SEQ ID NO: 259 - protein, 400 aa, Homo sapiens
MASEKPLAAVTCTAPVNIAVIKYWGKRDEELVLPINSSLSVTLHQDQLKTTTTAVISKDFTEDRIWLNGREEDVGQPRLQACLREIRCLARKRRNSRDGDPLPSSLSCKVHVASVNNFPTAAGLASSAAGYACLAYTLARVYGVESDLSEVARRGSGSACRSLYGGFVEWQMGEQADGKDSIARQVAPESHWPELRVLILVVSAEKKLTGSTVGMRASVETSPLLRFRAESVVPARMAEMARCIRERDFPSFAQLTMKDSNQFHATCLDTFPPISYLNAISWRIIHLVHRFNAHHGDTKVAYTFDAGPNAVIFTLDDTVAEFVAAVWHGFPPGSNGDTFLKGLQVRPAPLSAELQAALAMEPTPGGVKYIIVTQVGPGPQILDDPCAHLLGPDGLPKPAA

That which is claimed is:

1. A method of identifying a MYC-dependent synthetic lethal target gene in a MYC-dependent cancer, the method comprising:
   a) contacting a first tumor cell line, conditionally expressing MYC where human MYC transgene is overexpressed but its expression can be repressed by treatment with tetracycline or an analog thereof, with a CRISPR-based gene silencing agent comprising Cas9 nuclease targeting a target gene and a plurality of guide RNAs (gRNAs) targeting gene sequences to a population of the cells, using lentiviral infection at low titers so that each cell contains at most one gRNA;
   b) contacting a second tumor cell line, conditionally repressing MYC, with the CRISPR-based gene silencing agent comprising Cas9 nuclease targeting a target gene and a plurality of guide RNAs (gRNAs) targeting gene sequences to a population of the cells, using lentiviral infection at low titers so that each cell contains at most one gRNA; and
   c) detecting a phenotype of the first tumor cell line that is present in or quantitatively different in the second tumor cell line to identify the target gene as a MYC-dependent target gene,
   wherein the detecting comprises sequencing gRNAs present in the population from step (a) and in the population from step (b), comparing the gRNAs from the population from step (c) and in the population from step (b) to determine clonal dropouts under high MYC versus low MYC conditions; wherein the phenotype comprises the presence of dropout gRNAs, and wherein dropout RNAs present only in the population from step (b) but not in the population of step (a) are identified as MYC dependent synthetic lethal target genes.

2. The method according to claim 1, wherein MYC expression is repressed in the population of step (d) with doxycycline.

3. The method according to claim 1, wherein the first and second tumor cell lines are liver cancer cell lines and hepatocarcinoma cell lines.

4. The method of claim 1, further comprising:
   administering to a subject with a MYC-driven neoplasia, an effective amount of an inhibitor of a MYC-dependent target gene identified according to the method-claim 1.

5. The method of claim 1 wherein at least 20,611 genes are targeted with gRNAs.

* * * * *